(12) United States Patent
Hertzberg et al.

(10) Patent No.: US 10,570,407 B2
(45) Date of Patent: Feb. 25, 2020

(54) WOODY PLANTS HAVING IMPROVED GROWTH PROPERTIES

(71) Applicant: SweTree Technologies AB, Umeå (SE)

(72) Inventors: Magnus Hertzberg, Umeå (SE); Karin Johansson, Röbäck (SE); David Jonsén, Umeå (SE); Pär Jonsson, Umeå (SE); Linus Möller, Umeå (SE); Leif Jönsson, Umeå (SE); Madhavi Latha Gandla, Umeå (SE); Rishikesh Bhalerao, Umeå (SE); Jarmo Schrader, Bad Salzdetfurth (DE); Göran Sandberg, Umeå (SE)

(73) Assignee: SweTree Technologies AB, Umeå (SE)

( * ) Notice: Subject to any disclaimer, the term of this patent is extended or adjusted under 35 U.S.C. 154(b) by 167 days.

(21) Appl. No.: 15/536,631

(22) PCT Filed: Dec. 29, 2015

(86) PCT No.: PCT/SE2015/051936
§ 371 (c)(1),
(2) Date: Jun. 15, 2017

(87) PCT Pub. No.: WO2016/108750
PCT Pub. Date: Jul. 7, 2016

(65) Prior Publication Data
US 2017/0349910 A1  Dec. 7, 2017

(30) Foreign Application Priority Data
Dec. 29, 2014 (DK) .................................. 2014 70833

(51) Int. Cl.
*C12N 15/82* (2006.01)
*C07K 14/415* (2006.01)

(52) U.S. Cl.
CPC ........ *C12N 15/8261* (2013.01); *C07K 14/415* (2013.01)

(58) Field of Classification Search
None
See application file for complete search history.

(56) References Cited

U.S. PATENT DOCUMENTS

| | | | |
|---|---|---|---|
| 2011/0016550 A1* | 1/2011 | Hertzberg .......... | C12N 15/8261 800/260 |
| 2011/0167514 A1 | 7/2011 | Brover et al. | |
| 2013/0081153 A1* | 3/2013 | Dolan ................ | C12N 15/8261 800/278 |

FOREIGN PATENT DOCUMENTS

| | | | | |
|---|---|---|---|---|
| EP | 1033405 A2 | 9/2000 | | |
| EP | 2295582 A2 | 3/2011 | | |
| WO | 2006/040684 A2 | 4/2006 | | |
| WO | WO-2006040684 A2 * | 4/2006 | ......... | C12N 15/8246 |
| WO | 2008/125983 A2 | 10/2008 | | |
| WO | WO-2008125983 A2 * | 10/2008 | ........... | C07K 14/415 |
| WO | 2009/084999 A1 | 7/2009 | | |
| WO | WO-2009084999 A1 * | 7/2009 | ......... | C12N 15/8261 |
| WO | 2010/062240 A1 | 6/2010 | | |

OTHER PUBLICATIONS

Wells (Biochemistry 29:8509-8517, 1990).*
Guo et al. (PNAS, 101: 9205-9210, 2004 ).*
Ngo et al., (The Protein Folding Problem and Tertiary Structure Prediction, K. Merz., and S. Le Grand (eds.) pp. 492-495,1994).*
Thornton et al. (Nature structural Biology, structural genomics supplement, Nov. 2000).*
Keskin et al. (Protein Science, 13:1043-1055, 2004).*
Smith et al. (Nature Biotechnology, 15:1222-1223, 1997).*
Bork et al. (TIG, 12:425-427, 1996).*
Doerks et al., (TIG, 14:248-250, 1998).*
Nishimura et al. (Plant Cell Physiol., 41(5):583-590, 2000).*
Yang et al. (PNAS, 98:11438-11443, 2001).*
McConnell et al. (Nature, 411:709-713, 2001).*
International Search Report and Written Opinion received for PCT Patent Application No. PCT/SE2015/051396, dated Apr. 22, 2016, 25 pages.
Invitation to Pay Additional Fee received for PCT Patent Application No. PCT/SE2015/051396, dated Mar. 17, 2016, 11 pages.
Extended European Search Report (includes Supplementary European Search Report and European Search Opinion) received for European Patent Application No. 15875797.1, dated Sep. 10, 2018, 11 pages.
International Preliminary Report on Patentability received for PCT Patent Application No. PCT/SE2015/051396, dated Jul. 13, 2017, 14 pages.
Novaes et al., "Lignin and Biomass: A Negative Correlation for Wood Formation and Lignin Content in Trees", Plant Physiology, vol. 154, Oct. 2010, pp. 555-561.
Partial European Search Report received for European Patent Application No. 15875797.1, dated Jun. 4, 2018, 11 pages.
Uniport Accession No. B9INV5, Version 51, Available Online at <https://www.uniprot.org/uniprot/B9INV5>, Mar. 28, 2018, 2 pages.
Jeon et al., "Developing xylem-preferential expression of PdGA20ox1 , a gibberellin 20-oxidase 1 from Pinus densiflora, improves woody biomass production in a hybrid poplar", *Plant Biotechnology Journal* (2016) 14, pp. 1161-1170.

* cited by examiner

*Primary Examiner* — Vinod Kumar
(74) *Attorney, Agent, or Firm* — Morrison & Foerster, LLP

(57) ABSTRACT

The invention relates to a method for producing a genetically modified woody plant with improved growth properties (in terms of biomass and/or wood density) as compared to a corresponding non-genetically modified wild type plant or woody plant, said method comprising altering the level of expression of a polypeptide in a woody plant cell; a woody plant; or a part thereof.

6 Claims, 2 Drawing Sheets
Specification includes a Sequence Listing.

WOODY PLANTS HAVING IMPROVED GROWTH PROPERTIES

CROSS REFERENCE TO RELATED APPLICATIONS

This application is a U.S. National Phase patent application of PCT/SE2015/051396, filed Dec. 29, 2015, which claims priority to Denmark Patent Application No. PA201470833, filed Dec. 29, 2014, the disclosures of which are incorporated herein by reference in their entirety.

SUBMISSION OF SEQUENCE LISTING AS ASCII TEXT FILE

The content of the following submission on ASCII text file is incorporated herein by reference in its entirety: a computer readable form (CRF) of the Sequence Listing (file name: 616562022700SeqList.txt, date recorded: Jun. 9, 2017, size: 662 KB).

FIELD OF THE INVENTION

The invention relates to a method for producing a genetically modified plant or woody plant with improved growth properties (in terms of biomass, wood quality) as compared to a corresponding non-genetically modified wild type plant or woody plant, said method comprising altering the level of expression of a polypeptide in a plant or woody plant cell, a plant or woody plant, or a part thereof.

BACKGROUND TO THE INVENTION

Perennial plants such as long-lived trees and woody plants have a life style considerably different from annual plants, such as *Arabidopsis*, in that perennial plants such as trees has an indeterminate growth, whereas plants such as *Arabidopsis* terminate growth when the plant flowers.

Perennial plants can also cycle between periods of active growth and dormancy. The lifecycle of long-lived trees and woody plants differs significantly from annual crops, which often translocate carbon and nitrogen to seeds. Due to these differences between annual crops and perennial plants, such as trees, it has in many instances been found that a model system such as *Populus tremula* x *tremuloides* is a superior system for reliably finding genes, which can be used for increasing biomass production in woody plants.

Plant growth at apical meristems results in the development of sets of primary tissues and in the lengthening of the stem and roots. In addition to this primary growth, trees undergo secondary growth and produce secondary tissue "wood" from the cambium. This secondary growth increases the girth of stems and roots.

There are several factors such as different gene products that might need to be altered in order to enhance biomass production in trees. Growth in height, diameter, stem volume and wood density are important traits to follow for increased growth and biomass production. In view of the need to provide perennial plants capable of enhanced growth and biomass in a range of different environmental conditions, as well as changing environmental conditions, there is a continual need to provide plants with different genetic traits (comprising different sets of active genes) that adapt the plants for growth under these conditions.

In general, high yield plants can be made by crossing different lines, selecting plants with the best growing properties, where seeds from these plants can then be selected and new crosses can be performed. In this process, plants with better growth properties can be identified. One problem with trees and woody plants is that they need to be several years old before they produce flowers and can be used for traditional crossing. This can be overcome by using various molecular biology techniques.

This invention describes how expression of a set of genes can be altered to create transgenic woody plants, which have improved growth properties, improved biomass and higher yield compared to the corresponding non-genetically modified wild type woody plant.

SUMMARY OF THE INVENTION

The present invention provides a method for producing a genetically modified plant or woody plant having increased biomass and/or wood quality (wood density and/or wood biodegradability) compared to a corresponding non-genetically modified plant or woody plant of the same species, said method comprising:

(a) enhancing the level of expression of at least one polypeptide having an amino acid sequence selected from among SEQ ID NO.: 2, 28 and 38 or an ortholog thereof, and/or reducing the expression of at least one polypeptide having an amino acid sequence selected from among SEQ ID NO.: 58, 74, 88, 98, 106 and 128 or an ortholog or paralog thereof in a woody plant, a woody plant cell or a part thereof;

(b) generating and/or selecting a woody plant, woody plant cell or a part thereof with increased biomass and/or wood density as compared to a corresponding non-genetically modified woody plant; and (c) growing the woody plant, the woody plant cell or the part thereof under conditions which permit development of a woody plant.

In one embodiment of the method, the at least one polypeptide is selected from among:

(a) a polypeptide having an amino acid sequence selected from among SEQ ID NO: 2, 28, 38, 58, 74, 88, 98, 106 and 128;

(b) an ortholog polypeptide to the polypeptide having SEQ ID NO: 2, said ortholog polypeptide having at least 70% amino acid sequence identity to a sequence selected from among SEQ ID NO: 2, 4, 6, 8, 10, 12, 14, 16, 18, 20, 22, 24 and 26;

(c) an ortholog polypeptide to the polypeptide having SEQ ID NO: 28, said ortholog polypeptide having at least 70% amino acid sequence identity to a sequence selected from among SEQ ID NO: 28, 30, 32, 34 and 36;

(d) an ortholog polypeptide to the polypeptide having SEQ ID NO: 38, said ortholog polypeptide having at least 70% amino acid sequence identity to a sequence selected from among SEQ ID NO: 38, 40, 42, 44, 46, 48, 52, 54 and 56;

(e) an ortholog polypeptide to the polypeptide having SEQ ID NO: 58, said ortholog polypeptide having at least 70% amino acid sequence identity to a sequence selected from among SEQ ID NO: 58, 60, 62, 64, 66, 68, 70 and 72;

(f) an ortholog polypeptide to the polypeptide having SEQ ID NO: 74, said ortholog polypeptide having at least 70% amino acid sequence identity to a sequence selected from among SEQ ID NO: 74, 76, 78, 80, 82, 84 and 86; (g) an ortholog polypeptide to the polypeptide having SEQ ID NO: 88, said ortholog polypeptide having at least 70% amino acid sequence identity to a sequence selected from among SEQ ID NO: 88, 90, 92, 94 and 96;

(h) an ortholog polypeptide to the polypeptide having SEQ ID NO: 98, said ortholog polypeptide having at least 70% amino acid sequence identity to a sequence selected from among SEQ ID NO: 98, 100, 102 and 104;

(i) an ortholog polypeptide to the polypeptide having SEQ ID NO: 106, said ortholog polypeptide having at least 70% amino acid sequence identity to a sequence selected from among SEQ ID NO: 106, 108, 110, 112, 114, 116, 118, 120, 122, 124 and 126; and (j) an ortholog polypeptide to the polypeptide having SEQ ID NO: 128, said ortholog polypeptide having at least 70% amino acid sequence identity to a sequence selected from among SEQ ID NO: 128, 130, 132, 134, 136 and 138.

In one embodiment of the method, the genetically modified woody plant is a hardwood tree selected from the group consisting of acacia, *eucalyptus*, hornbeam, beech, mahogany, walnut, oak, ash, willow, hickory, birch, chestnut, poplar, alder, aspen, maple, sycamore, ginkgo, a palm tree and sweet gum.

In one alternative embodiment of the method, the genetically modified woody plant of the method is a conifer selected from the group consisting of cypress, Douglas fir, fir, *sequoia*, hemlock, cedar, juniper, larch, pine, redwood, spruce and yew.

In one embodiment of the method, the genetically modified plant of the method is a crop plant, for example sugarcane, pumpkin, maize (corn), wheat, rice, barley, rye, rape, forage grass, beet, cassava, soybeans, potatoes and cotton.

The invention provides a genetically modified woody plant, having increased biomass and/or wood quality (wood density and/or wood biodegradability) as compared to a corresponding non-genetically modified woody plant of the same species that is produced by the method of the invention.

The invention further provides a genetically modified woody plant having increased biomass and/or wood density as compared to a corresponding non-genetically modified woody plant of the same species, said plant having an enhanced level of expression of at least one polypeptide having an amino acid sequence selected from among SEQ ID NO.: 2, 28 and 38 or an ortholog/paralog thereof, and/or reducing the expression of at least one polypeptide having an amino acid sequence selected from among SEQ ID NO.: 58, 74, 88, 98, 106 and 128 or an ortholog/paralog.

In one embodiment, the genetically modified woody plant is a hardwood tree selected from the group consisting of acacia, *eucalyptus*, hornbeam, beech, mahogany, walnut, oak, ash, willow, hickory, birch, chestnut, poplar, alder, aspen, maple, sycamore, ginkgo, a palm tree and sweet gum.

In an alternative embodiment, the genetically modified woody plant of the method is a conifer selected from the group consisting of cypress, douglas fir, fir, *sequoia*, hemlock, cedar, juniper, larch, pine, redwood, spruce and yew.

In one embodiment of the method, the genetically modified plant of the method is a crop plant, for example sugarcane, pumpkin, maize (corn), wheat, rice, barley, rye, rape, forage grass, beet, cassava, soybeans, potatoes and cotton.

DEFINITIONS

Figure 1:
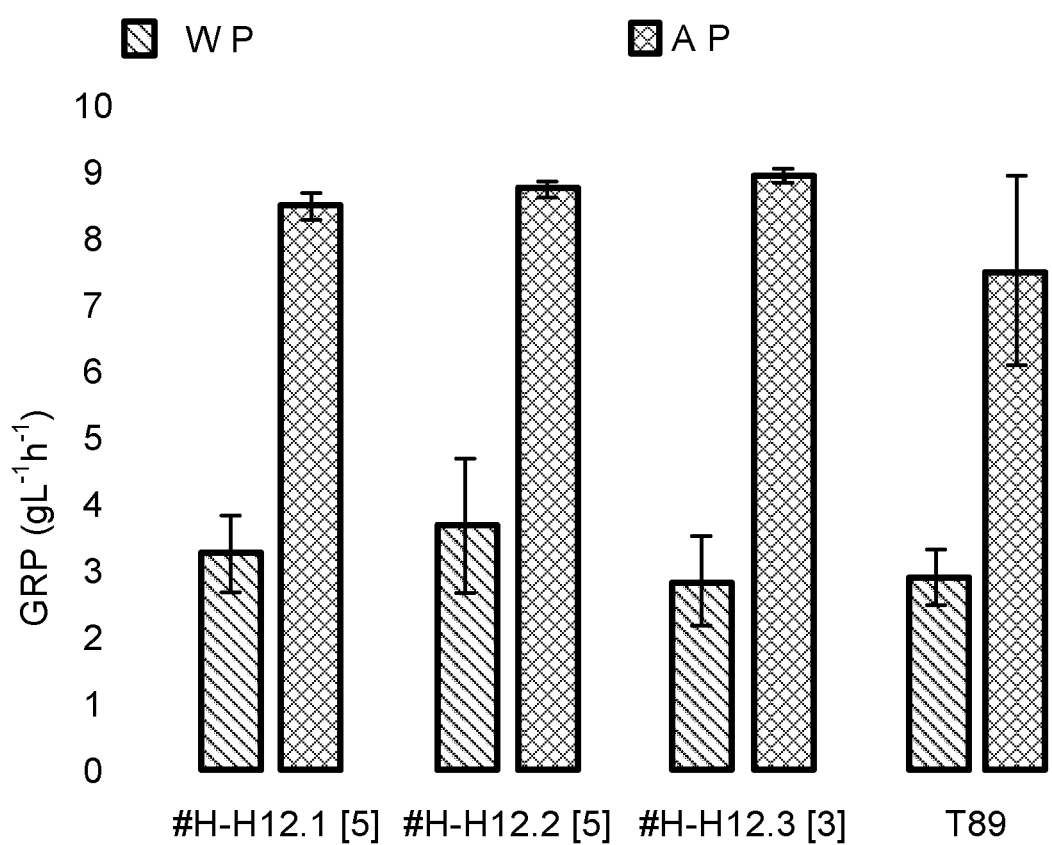
FIG. 1: Glucose production rates of wood samples obtained from transgenic aspen expressing construct 35S022 and wild-type aspen, where the samples were prepared without [WP] or with [AP] an acid pre-treatment step.

The term "improved growth properties" should be understood as primary growth, including a lengthening of the stem and roots, as well as secondary growth of a woody plant including production of secondary tissue, "wood", from the cambium and an increase in the girth of stems and roots. One way of monitoring growth is by measuring the height and the diameter of the stem and optionally calculating the volume of the stem and comparing it with a wild type population or with parental control of the woody plants of interest. Improved growth produces a plant with increased biomass. Wood density is a positive measure of wood quality.

The term "improved wood quality" should, in one aspect be understood as increased biodegradability of wood; in particular the saccharification yield obtainable from wood derived from a woody plant of the invention. In particular, the susceptibility of cellulose in a wood derived from a woody plant to enzymatic cleavage and deconstruction of the polymeric wood structure, as measurable by the yield of soluble sugars released on cleavage and deconstruction, is a measure of wood quality. Another aspect of wood quality is wood density which influences factors such as strength of both fibrous products and solid wood products. Wood density also influences paper yield and properties. Wood density is a key factor for kraft pulp production.

By "conditions which permit development of a tree" is meant that the normal growth of the non-genetically modified woody plant, i.e. the woody plant should be grown in the normal climate zone of the woody plant. The temperature, day light and access to water and nutrients should be the norm for the growth region. An advantage with an improved growth of the genetically modified woody plant is that the improvement may also affect the survival of the genetically modified woody plants in an environment in which the non-genetically modified woody plants does not grow. This is very important from a commercial point of view.

By "biologically active variant" of a polypeptide is meant a polypeptide, protein or a stretch of amino acids, which have the same activity as the chosen polypeptide, but a different amino acid sequence, i.e. a biologically active variant of a polypeptide can perform the same enzymatic reaction to create the same activity.

By "ortholog" or "orthologous polypeptide" is meant a polypeptide expressed by evolutionarily related gene that has a similar nucleic acid sequence, where the polypeptide has similar functional properties. Orthologous genes are structurally related genes, from different species, derived by a speciation event from an ancestral gene. Related to orthologs are paralogs. Paralogous genes are structurally related genes within a single plant species most probably derived by a duplication of a gene. The word ortholog and paralog are used interchangeably in the entire text and the text may use the term ortholog/paralog, where it is difficult to distinguish between orthologs and paralogs. Several different methods are known by those of skill in the art for identifying and defining these functionally homologous sequences. An ortholog, a paralog or a homologous gene may be identified by one or more of the methods described below.

"Orthologous genes" from different organisms have highly conserved functions and can be used for identification of genes that could perform the invention in the same way as the genes presented here. Paralogous genes, which have diverged through gene duplication, may encode protein retaining similar functions. Orthologous genes are the product of speciation, the production of new species from a parental species, giving rise to two or more genes with common ancestry and with similar sequence and similar function. These genes, are termed orthologous genes, often have an identical function within their host plants and are often interchangeable between species without losing function. Identification of an "ortholog" gene may be done by identifying polypeptides in public databases using the software tool BLAST with one of the polypeptides encoded by a gene. Subsequently additional software programs are used to align and analyse ancestry. The sequence identity between two orthologous genes may be low.

Implementation of such identification and analysis methods is illustrated in the introduction to the Examples.

The terms "substantially identical" or "sequence identity" may indicate a quantitative measure of the degree of homology between two amino acid sequences or two nucleic acids (DNA or RNA) of equal length. When the two sequences to be compared are not of equal length, they are aligned to give the best possible fit, by allowing the insertion of gaps or, alternatively, truncation at the ends of the polypeptide sequences or nucleotide sequences. The "sequence identity" may be presented as percent number, such as at least 40, 50%, 55,%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, or at least 99% amino acid sequence identity of the entire length, when compared and aligned for maximum correspondence, as measured using a sequence comparison algorithm or by visual inspection.

In certain aspects, substantial identity exists over a region of nucleic acid sequences of at least about 50 nucleic acid residues, such as at least about 100, 150, 200, 250, 300, 330, 360, 375, 400, 425, 450, 460, 480, 500, 600, 700, 800 such as at least about 900 nucleotides or such as at least about 1 kb, 2 kb, or such as at least about 3 kb.

In some aspects, the amino acid substantial identity exists over an polypeptide sequences length of 10, 15, 20, 25, 30, 35, 40, 45, 50, 55, 60, 65, 70, 75, 80, 85, 90, 95, 100, 110, 120, 130, 140, 150, 160, 170, 180, 190, 200, 250, 300, 350, 400, 450, 500, 600, 700 amino acids in the polypeptide with a "sequence identity" as defined above.

The sequence identity of the polypeptides of the invention can be calculated as $(N_{ref}-N_{dif})100/N_{ref}$, wherein $N_{dif}$ is the total number of non-identical residues in the two sequences when aligned and wherein $N_{ref}$ is the number of residues in one of the sequences. The sequence identity between one or more sequence may also be based on global alignments using the clustalW software. In one embodiment of the invention, alignment is performed with the sequence alignment method ClustalW with default parameters. The parameter set preferably used are for pairwise alignment: Gap open penalty: 10; Gap Extension Penalty: 0.1, for multiple alignment, Gap open penalty is 10 and Gap Extension Penalty is 0.2. Protein Weight matrix is set on Identity. Both Residue-specific and Hydrophobic Penalties are "ON", Gap separation distance is 4 and End Gap separation is "OFF", No Use negative matrix and finally the Delay Divergent Cut-off is set to 30%.

Preferably, the numbers of substitutions, insertions, additions or deletions of one or more amino acid residues in the polypeptide as compared to its comparator polypeptide is limited, i.e. no more than 1, 2, 3, 4, 5, 6, 7, 8, 9, or 10 substitutions, no more than 1, 2, 3, 4, 5, 6, 7, 8, 9, or 10 insertions, no more than 1, 2, 3, 4, 5, 6, 7, 8, 9, or 10 additions, and no more than 1, 2, 3, 4, 5, 6, 7, 8, 9, or 10 deletions. Preferably the substitutions are conservative amino acid substitutions: limited to exchanges within members of group 1: Glycine, Alanine, Valine, Leucine, Isoleucine; group 2: Serine, Cysteine, Selenocysteine, Threonine, Methionine; group 3: proline; group 4: Phenylalanine, Tyrosine, Tryptophan; Group 5: Aspartate, Glutamate, Asparagine, Glutamine.

The terms "hybridization" and "hybridize" are used broadly to designate the association between complementary or partly complementary nucleic acid sequences. Under "stringent hybridization conditions", nucleic acid base pairing will occur only between nucleic acid fragments that have a high frequency of complementary base sequences.

The length of the polynucleotide fragment also affects the hybridization. An example of "stringent hybridization conditions" can be using a polynucleotide sequence of at least 15, 20, 25, 30, 35, 40, 45, 50, 100, or at least 200 consecutive nucleotide residues, which hybridizes in 5× saline sodium citrate (SSC) at 40° C., followed by one or more washes in 2×SSC, 0.2% sodium dodecyl sulphate (SDS) at 65° C. Lower temperature will reduce the stringency. More details about hybridization methods are found in the art.

By "altering" is meant altering the level or the activity of a gene product. In this way "altering" is used for modifying, increasing, decreasing, reducing but not abolishing the levels or the activity of a gene product within the plant. It can also refer to changing the expression of the genes presented here; which can be used to modify the desired properties.

Approaches to obtaining altered levels or activity of a gene product can be done by using the nucleic acid construct as described for the identification of plants having altered growth characteristics as compared to the wild-type. Such plants may for instance be naturally occurring variants or plants that have been modified genetically to exhibit altered growth properties. For such purposes, the nucleic acid sequences according to the invention can be used as targets to identify genetic variation that can be exploited as markers in a breeding program, e.g. as a probe in conventional hybridization assays or as a primer for specific amplification of nucleic acid fragments.

The phrase "regulatory nucleic acid sequences" refers to regulatory binding sites, promoters, poly-A signals and the similar.

By "reducing the amount or activity" of a polypeptide is meant that the transcription and/or processing of mRNA might be reduced, whereby the subsequent translation of the mRNA into a functional polypeptide may result in a lower amount of the polypeptide. The polypeptide can be protein or an enzyme. When the amount of an enzyme is reduced the activity might be reduced.

By "increasing the amount or activity" of a polypeptide is meant that the transcription of mRNA might be increased, the mRNA processing might be affected, resulting in an increase of the mRNA, whereby the translation of the mRNA into a functional polypeptide may result in a higher amount of the polypeptide. The polypeptide can be a protein or more specifically an enzyme. When the amount of an enzyme is increased the activity might be increased. Increasing the amount or activity of a polypeptide can also be achieved by introducing a nucleic acid sequences into a host cell, expressing said nucleic acid sequences and translating it into a functional polypeptide. The functional polypeptide might not normally be present or only normally expressed from the endogenous gene at a lower level, in such cases the amount or activity of the polypeptide/enzyme is increased.

By "over-expressing" or "increased expression" is meant that a nucleic acid sequence after its introduction into a host cell is expressed at a higher level than that normally expressed from the endogenous host gene encoding said polypeptide or protein.

DETAILED DESCRIPTION OF THE INVENTION

1. A Method for Increasing the Biomass Yield and/or Wood Density of a Plant or Woody Plant The present invention provides methods for producing a genetically modified plant or woody plant having increased growth; whereby the woody plant product yields increased biomass and/or increased wood density. The genetically modified (GM) plant or woody plant provided by the invention, is characterised by an increased height, diameter, stem volume, wood density, or any combination thereof, when compared to a non-genetically modified (non-GM) wild type population or to a parental plant or woody plant used as control. Increased growth of a woody plant may result from increased primary growth, including lengthening of the stem and roots, as well as increased secondary growth, including production of secondary tissue "wood" from the cambium giving rise to an increase in the girth of stems and roots.

It has surprisingly been found that genetic modification of a plant or woody plant causing an altered expression level of one or more polypeptide selected from among STT74, STT681, STT632, STT153, STT258, ST387, STT543, STT793, and STT795, wherein the amino acid of said polypeptide is SEQ ID NO: 2, 28, 38, 58, 74, 88, 98, 106 and 128 respectively, or an ortholog or paralog thereof, and wherein the altered expression of said one or more polypeptide produces a plant having an increased biomass and/or increased wood density and/or wood quality. An ortholog or paralog of the polypeptide is a polypeptide having at least 40%, 45%, 50%, 55%, 60%, 65% 70%, 75%, 80%, 81%, 82%, 83%, 84%, 85%, 86%, 87%, 88%, 89%, 90%, 91%, 92%, 93%, 94%, 95%, 96%, 97%, 98%, at least 99% or 100% amino acid sequence identity any one of SEQ ID NO: 2, 28, 38, 58, 74, 88, 98, 106 and 128; or a portion of any one of SEQ ID NO: 2, 28, 38, 58, 74, 88, 98, 106 and 128, as defined below in respect of each sequence.

It is known in the art that polypeptides encoded by orthologous genes retain their functional properties when transgenically expressed in heterologous plants or woody plants. For example, the expression of genes, derived from *Arabidopsis thaliana*, in tobacco and in trees confers the same phenotypic properties on the transformed plant.

Thus a polypeptide that is an ortholog to one of those described herein (e.g STT74, ST681, STT632) is expected to function in the same way and improve the growth properties when over-expressed in woody plants. The expression of polypeptides encoded by orthologous genes in a woody plant, according to the present invention, has particular value since it makes it possible to improve the growth properties of a woody plant of high economic value, but where the native gene encoding the polypeptide to be expressed is not known. Similarly, reduced expression of a polypeptide that is an ortholog to one of those described herein (e.g. STT153, STT258, STT387, STT543, STT793, and STT795) encoded by an orthologous gene in a GM woody plant of the invention, by virtue of its conserved functional properties, is expected to improve the growth properties of the GM woody plants.

In a one embodiment, the invention provides a method for increasing the biomass and/or wood density and/or wood quality of a plant or woody plant; wherein the plant or woody plant is genetically modified in order to increase the level of expression of one or more polypeptide, wherein the amino acid sequence of the polypeptide has at least 70% sequence identity to a sequence selected from among SEQ ID NO: 2, 28, 38 (corresponding to STT74, STT681 and STT632 respectively), or an ortholog or paralog thereof as defined below in respect of each sequence.

In a further embodiment, the invention provides a method for increasing the biomass yield and/or wood density and/or wood quality of a plant or woody plant; wherein the plant or woody plant is genetically modified in order to decrease the level of expression of one or more polypeptide, wherein the amino acid sequence of the polypeptide has at least 70% sequence identity to a sequence selected from among SEQ ID NO: 58, 74, 88, 98, 106, 128 (corresponding to STT153, STT258, STT387, STT543, STT793 and STT795, respectively) or an ortholog or paralog as defined below in respect of each sequence.

1.1 Enhanced Expression of a Polypeptide (STT74) Having SEQ ID NO 2, or an Ortholog or Paralog Thereof, in a Plant or Woody Plant In one embodiment, enhancing the expression of a polypeptide (STT74) having SEQ ID NO: 2 or an ortholog or paralog thereof, in a GM plant or woody plant confers enhanced growth when compared to a non-GM plant or woody plant used as control, as measured as the height, and diameter and volume of the plant; as well as enhanced wood density (see example 1) and wood quality (see example 11). Functional properties assigned to the expressed polypeptide are those of a vesicle-associated membrane protein.

In one embodiment, the amino acid sequence of the polypeptide has at least 70% sequence identity to SEQ ID NO: 2, and is selected from among SEQ ID NO: 2 (corresponding to *Populus trichocarpa* polypeptide encoded by gene POPTR_0019s13890); SEQ ID NO: 4 (corresponding to *Populus trichocarpa* polypeptide encoded by gene Potri.013G147800.2); or SEQ ID NO:6 (corresponding to *Populus trichocarpa* polypeptide encoded by gene Potri.019G116400).

Alternatively, the polypeptide has at least 70% sequence identity to amino acid residues 60 to 267 of SEQ ID NO 2, and is selected from among SEQ ID NO: 8 (corresponding to *Populus trichocarpa* polypeptide encoded by gene Potri.001G408200.1); SEQ ID NO: 10 (corresponding to *Populus trichocarpa* polypeptide encoded by gene Potri.004G033500); SEQ ID NO: 12 (corresponding to *Populus trichocarpa* polypeptide encoded by gene Potri.011G041900.1); SEQ ID NO: 14 (corresponding to *Populus trichocarpa* polypeptide encoded by gene Potri.011G126200.2); SEQ ID NO:16 (corresponding to *Eucalyptus grandis* polypeptide encoded by gene F01073); SEQ ID NO:18 (corresponding to *Eucalyptus grandis* polypeptide encoded by gene K00911); SEQ ID NO:20 (corresponding to *Eucalyptus grandis* polypeptide encoded by gene D00750); SEQ ID NO: 22 (corresponding to *Arabidopsis thaliana* polypeptide encoded by gene AT4G05060); SEQ ID NO: 24 (corresponding to *Arabidopsis thaliana* polypeptide encoded by gene AT4G21450); and SEQ ID NO: 26 (corresponding to *Arabidopsis thaliana* polypeptide encoded by gene AT5G54110).

In a preferred embodiment a polypeptide having at least 70% sequence identity to amino acid residues 60 to 267 of SEQ ID NO 2, for expression in a GM plant or woody plant to enhance growth when compared to a non-GM plant or woody plant used as control, is characterised by comprising all peptides listed in Table 1, wherein the amino acid sequence of peptide STT74pep1 has at least 70% sequence identity to the corresponding region in SEQ ID NO: 2, the amino acid sequence of peptide STT74pep2 has at least 80% sequence identity to the corresponding region in SEQ ID NO: 2, and the amino acid sequence of peptide STT74pep3 has at least 90% sequence identity to the corresponding region in SEQ ID NO: 2.

TABLE 1

Peptides defining the STT74 polypeptide

| | Amino acid position in Seq ID No.: 2 | | Length - No. |
|---|---|---|---|
| | First | Last | amino acids |
| STT74pep1 | 72 | 267 | 195 |
| STT74pep2 | 84 | 153 | 70 |
| STT74pep3 | 122 | 132 | 10 |

1.2 Enhanced Expression of a Polypeptide (STT681) Having SEQ ID NO 28, or an Ortholog or Paralog Thereof, in a Plant or Woody Plant In one embodiment, enhancing expression of a polypeptide (STT681) having SEQ ID NO: 28, or an ortholog or paralog thereof, in a GM plant or woody plant confers enhanced growth when compared to a non-genetically modified (GM) woody plant used as control, as measured as the height, and diameter and volume of the plant; as well as enhanced wood density (see example 2). Functional properties assigned to the expressed polypeptide are those of a GTPase activating protein.

In one embodiment, the amino acid sequence of the polypeptide has at least 70% sequence identity to SEQ ID NO: 28, and is selected from among SEQ ID NO: 28 (corresponding to *Populus trichocarpa* polypeptide encoded by gene POPTR_0001s38090); SEQ ID NO:30 (corresponding to *Populus trichocarpa* polypeptide encoded by gene Potri.011G098500); SEQ ID NO:32 (corresponding to *Eucalyptus grandis* polypeptide encoded by gene Eucgr.D00176); SEQ ID NO:34 (corresponding to *Arabidopsis thaliana* polypeptide encoded by gene AT4G21160); and SEQ ID NO:36 (corresponding to *Arabidopsis thaliana* polypeptide encoded by gene AT4G05330).

In a preferred embodiment a polypeptide having at least 70% sequence identity to SEQ ID NO: 28, for expression in a GM plant or woody plant to enhance growth when compared to a non-GM plant or woody plant used as control, is characterised by comprising all of the peptides listed in Table 2, wherein the amino acid sequence of each of peptide STT681pep1, peptide STT681pep2, peptide STT681pep3 and peptide STT681pep4 respectively has substantial sequence identity, or is identical, to the corresponding region in SEQ ID NO: 28.

TABLE 2

Peptides defining the STT681polypeptide

| | Amino acid position in Seq ID No.: 28 | | Length - No. |
|---|---|---|---|
| | First | Last | amino acids |
| STT681pep1 | 29 | 39 | 11 |
| STT681pep2 | 47 | 76 | 30 |
| STT681pep3 | 183 | 229 | 47 |
| STT681pep4 | 239 | 256 | 18 |

1.3 Enhanced Expression of a Polypeptide (STT632) Having SEQ ID NO: 38, or an Ortholog or Paralog Thereof, in a Plant or Woody Plant In one embodiment, enhancing expression of a polypeptide (STT632) having SEQ ID NO: 38, or an ortholog or paralog thereof, in a GM plant or woody plant confers enhanced growth when compared to a non-GM plant or woody plant used as control, as measured as the height, and diameter and volume of the plant; as well as enhanced wood density (see example 3). The expressed polypeptide functions as a transcription factor, and belongs to the so called WRKY family, characterized by a conserved region with the amino acids WRKY. While not wishing to be bound by theory, the functional properties assigned to WRKY family polypeptides, that contribute to the observed increase in woody plant growth and density, includes enhancing stress tolerance, eg. heat and salt tolerance.

In one embodiment, the amino acid sequence of the polypeptide has at least 70% sequence identity to a sequence selected from among SEQ ID NO: 38 (corresponding to *Populus trichocarpa* polypeptide encoded by gene POPTR_0013s14960 gene); SEQ ID NO: 40 (corresponding to *Populus trichocarpa* polypeptide encoded by gene Potri.013G153400.1); SEQ ID NO:42 (corresponding to *Populus trichocarpa* polypeptide encoded by gene Potri.006G105300.1); SEQ ID NO: 44 (corresponding to *Populus trichocarpa* polypeptide encoded by gene Potri.016G128300.1); SEQ ID NO:46 (corresponding to *Populus trichocarpa* polypeptide encoded by gene Potri.019G123500.2); SEQ ID NO: 48 (corresponding to *Eucalyptus grandis* polypeptide encoded by gene Eucgr.B04010); SEQ ID NO: 50 (corresponding to *Eucalyptus grandis* polypeptide encoded by gene Eucgr.K02940); SEQ ID NO: 52 (corresponding to *Arabidopsis thaliana* polypeptide encoded by gene AtWRKY25 (AT2G30250)); SEQ ID NO: 54 (corresponding to *Arabidopsis thaliana* polypeptide encoded by gene AtWRKY33 (AT2G38470)); and SEQ ID NO: 56 (corresponding to *Arabidopsis thaliana* polypeptide encoded by gene AtWRKY26 (AT5G07100)).

In a preferred embodiment a polypeptide having at least 50% sequence identity to SEQ ID NO: 38, for expression in a GM plant or woody plant to enhance growth when compared to a non-GM plant or woody plant used as control, is characterised by comprising all of the peptides listed in Table 3, wherein the amino acid sequence of each of peptide STT632pep1, peptide STT632pep2, peptide STT632pep3, peptide STT632pep4, peptide STT632pep5 and peptide STT632pep6 respectively, has substantial sequence identity, or is identical, to the corresponding region in SEQ ID NO: 38.

TABLE 3

Peptides defining the ST632 polypeptide

| | Amino acid position in Seq ID No.: 38 | | Length - No. amino acids |
|---|---|---|---|
| | First | Last | |
| STT632pep1 | 69 | 79 | 11 |
| STT632pep2 | 119 | 133 | 15 |
| STT632pep3 | 263 | 284 | 22 |
| STT632pep4 | 274 | 280 | 7 |
| STT632pep5 | 267 | 280 | 14 |
| STT632pep6 | 263 | 324 | 62 |
| STT632pep7 | 258 | 315 | 58 |
| STT632pep8 | 430 | 488 | 59 |

1.4 Decreased Expression of a Polypeptide (STT153) Having SEQ ID NO: 58, or an Ortholog or Paralog Thereof, in a Plant or Woody Plant In one embodiment, decreased expression of a polypeptide (STT153) having SEQ ID NO: 58, or an ortholog or paralog thereof, in a GM plant or woody plant confers enhanced growth when compared to a non-GM plant or woody plant used as control, as measured as the height, and diameter and volume of the plant; as well as enhanced wood density (see example 4). Functional properties assigned to the expressed polypeptide are those of a zinc finger protein.

In one embodiment, amino acid sequence of the polypeptide, whose expression is decreased, has at least 70% sequence identity to a sequence selected from among SEQ ID NO: 58 (corresponding to *Populus trichocarpa* polypeptide encoded by gene POPTR_0018s01490 (v3.0 updated to Potri.018G029900)); SEQ ID NO: 60 (corresponding to *Populus trichocarpa* polypeptide encoded by gene Potri.006G251300.1); SEQ ID NO: 62 (corresponding to *Populus trichocarpa* polypeptide encoded by gene Potri.001G172700.1); SEQ ID NO: 64 (corresponding to *Eucalyptus grandis* polypeptide encoded by gene Eucgr. F02548.1); SEQ ID NO:66 (corresponding to *Eucalyptus grandis* polypeptide encoded by gene Eucgr.C02807.1); SEQ ID NO:68 (corresponding to *Eucalyptus grandis* polypeptide encoded by gene Eucgr. C01779.1); SEQ ID NO: 70 (corresponding to *Arabidopsis thaliana* polypeptide encoded by gene AT5G25490.1); and SEQ ID NO: 72 (corresponding to *Arabidopsis thaliana* polypeptide encoded by gene AT3G15680.1).

In a preferred embodiment a polypeptide having at least 65% sequence identity to SEQ ID NO: 58, whose expression is reduced in a GM plant or woody plant to enhance growth when compared to a non-GM plant or woody plant used as control, is characterised by comprising all of the peptides listed in Table 4, wherein the amino acid sequence of peptide STT153pep1, peptide STT153pep2, peptide STT153pep3, peptide STT153pep4, peptide STT153pep5, peptide STT153pep6, and peptide STT153pep7 respectively, has substantial sequence identity, or is identical, to the corresponding region in SEQ ID NO: 58.

TABLE 4

Peptides defining the STT153polypeptide

| | Amino acid position in Seq ID No.: 58 | | Length - No. amino acids |
|---|---|---|---|
| | First | Last | |
| STT153pep1 | 1 | 30 | 30 |
| STT153pep2 | 38 | 92 | 55 |

TABLE 4-continued

Peptides defining the STT153polypeptide

| | Amino acid position in Seq ID No.: 58 | | Length - No. amino acids |
|---|---|---|---|
| | First | Last | |
| STT153pep3 | 47 | 62 | 16 |
| STT153pep4 | 56 | 87 | 32 |
| STT153pep5 | 65 | 82 | 18 |
| STT153pep6 | 113 | 147 | 35 |
| STT153pep7 | 119 | 136 | 18 |

1.5 Decreased Expression of a Polypeptide (STT258) Having SEQ ID NO: 74, or an Ortholog or Paralog Thereof, in a Plant or Woody Plant In one embodiment, decreased expression of a polypeptide having SEQ ID NO: 74, or an ortholog or paralog thereof, in a GM plant or woody plant confers enhanced growth when compared to a non-GM plant or woody plant used as control, as measured as the height, and diameter and volume of the plant; as well as enhanced wood density (see example 5). Functional properties assigned to the expressed polypeptide are those of a calmodulin binding protein.

In one embodiment, the amino acid sequence of the polypeptide, whose expression is decreased, has at least 70% sequence identity to a sequence selected from among SEQ ID NO: 74 (corresponding to *Populus trichocarpa* gene POPTR_0013s13090, (or v3.0 updated to Potri.013G127200,)); SEQ ID NO: 76 (corresponding to *Populus trichocarpa* polypeptide encoded by gene Potri.019G095700); SEQ ID NO: 78 (corresponding to *Populus trichocarpa* polypeptide encoded by gene Potri.019G112400.1); SEQ ID NO: 80 (corresponding to *Eucalyptus grandis* polypeptide encoded by gene Eucgr.H00308.1); SEQ ID NO: 82 (corresponding to *Eucalyptus grandis* polypeptide encoded by gene Eucgr.L00007.2); SEQ ID NO: 84 (corresponding to *Arabidopsis thaliana* polypeptide encoded by gene AT3G59690.1); and SEQ ID NO: 86 (corresponding to *Arabidopsis thaliana* polypeptide encoded by gene AT2G43680.3).

In a preferred embodiment a polypeptide having at least 60% sequence identity to SEQ ID NO: 74, whose expression is reduced in a GM plant or woody plant to enhance growth when compared to a non-GM plant or woody plant used as control, is characterised by comprising all of the peptides listed in Table 5, wherein the amino acid sequence of each of peptide STT258pep1, peptide STT258pep2, peptide STT258pep3, peptide STT258pep4, peptide STT258pep5, peptide STT258pep6, peptide STT258pep7, peptide STT258pep8, peptide STT258pep9, and peptide STT258pep10 respectively, has substantial sequence identity, or is identical, to the corresponding region in SEQ ID NO: 74.

TABLE 5

Peptides defining the STT258 polypeptide

| | Amino acid position in Seq ID No.: 74 | | Length - No. amino acids |
|---|---|---|---|
| | First | Last | |
| STT258pep1 | 1 | 15 | 15 |
| STT258pep2 | 1 | 26 | 26 |

TABLE 5-continued

Peptides defining the STT258 polypeptide

| | Amino acid position in Seq ID No.: 74 | | Length - No. amino acids |
|---|---|---|---|
| | First | Last | |
| STT258pep3 | 33 | 85 | 53 |
| STT258pep4 | 107 | 128 | 22 |
| STT258pep5 | 130 | 224 | 85 |
| STT258pep6 | 153 | 183 | 30 |
| STT258pep7 | 249 | 295 | 47 |
| STT258pep8 | 410 | 460 | 51 |
| STT258pep9 | 463 | 482 | 20 |
| STT258pep10 | 507 | 517 | 11 |

1.6 Decreased Expression of a Polypeptide (STT387) Having SEQ ID NO: 88, or an Ortholog or Paralog Thereof, in a Plant or Woody Plant In one embodiment, decreased expression of a polypeptide having SEQ ID NO: 88, or an ortholog or paralog thereof, in a GM plant or woody plant confers enhanced growth when compared to a non-GM plant or woody plant used as control, as measured as the height, and diameter and volume of the plant; as well as enhanced wood density (see example 6). The functional properties annotated to the expressed polypeptide are those of the enzyme shikimate dehydrogenase.

In one embodiment, the amino acid sequence of the polypeptide, whose expression is decreased, has at least 70% sequence identity to a sequence selected from among SEQ ID NO: 88 (corresponding to *Populus trichocarpa* gene Potri.013G029900 gene); SEQ ID NO: 90 (corresponding to *Populus trichocarpa* polypeptide encoded by gene Potri.005G043400.1); SEQ ID NO:92 (corresponding to *Eucalyptus grandis* polypeptide encoded by gene Eucgr.B01770.1); SEQ ID NO:94 (corresponding to *Eucalyptus grandis* polypeptide encoded by gene Eucgr.H01214.1); and SEQ ID NO:96 (corresponding to *Arabidopsis thaliana* polypeptide encoded by gene AT3G06350.1).

In a preferred embodiment a polypeptide having at least 55% sequence identity to SEQ ID NO: 88, whose expression is reduced in a GM plant or woody plant to enhance growth when compared to a non-GM plant or woody plant used as control, is characterised by comprising all of the peptides listed in Table 6, wherein the amino acid sequence of each of peptide STT387pep1, peptide STT387pep2, peptide STT387pep3, peptide STT387pep4, peptide STT387pep5, peptide STT387pep6, peptide STT387pep7, peptide STT387pep8, and peptide STT387pep9 has substantial sequence identity, or is identical, to the corresponding region in SEQ ID NO: 88.

TABLE 6

Peptides defining the STT387 polypeptide

| | Amino acid position in Seq ID No.: 88 | | Length - No. amino acids |
|---|---|---|---|
| | First | Last | |
| STT387pep1 | 14 | 25 | 12 |
| STT387pep2 | 36 | 46 | 10 |
| STT387pep3 | 71 | 84 | 14 |
| STT387pep4 | 90 | 110 | 21 |
| STT387pep5 | 189 | 206 | 18 |
| STT387pep6 | 237 | 258 | 22 |

TABLE 6-continued

Peptides defining the STT387 polypeptide

| | Amino acid position in Seq ID No.: 88 | | Length - No. amino acids |
|---|---|---|---|
| | First | Last | |
| STT387pep7 | 306 | 338 | 32 |
| STT387pep8 | 363 | 393 | 31 |
| STT387pep9 | 458 | 472 | 15 |

1.7 Decreased Expression of a Polypeptide (STT543) Having SEQ ID NO: 98, or an Ortholog or Paralog Thereof, in a Plant or Woody Plant In one embodiment, decreased expression of a polypeptide having SEQ ID NO: 98, or an ortholog or paralog thereof, in a GM plant or woody plant confers enhanced growth when compared to a non-GM plant or woody plant used as control, as measured as the height, and diameter and volume of the plant; as well as enhanced wood density (see example 7). Functional properties assigned to the expressed polypeptide are those of a 2-oxoglutarate- and Fe (II)-dependent oxygenase.

In one embodiment, the amino acid sequence of the polypeptide, whose expression is decreased, has at least 70% sequence identity to a sequence selected from among SEQ ID NO: 98 (corresponding to *Populus trichocarpa* gene Potri.009G107600); SEQ ID NO: 100 (corresponding to *Eucalyptus grandis* polypeptide encoded by gene Eucgr.I01206.1); SEQ ID NO: 102 (corresponding to *Arabidopsis thaliana* polypeptide encoded by gene AT3G19000.1); and SEQ ID NO:104 (corresponding to *Arabidopsis thaliana* polypeptide encoded by gene AT3G19010.1).

In a preferred embodiment a polypeptide having at least 65% sequence identity to SEQ ID NO: 98, whose expression is reduced in a GM plant or woody plant to enhance growth when compared to a non-GM plant or woody plant used as control, is characterised by comprising all of the peptides listed in Table 7, wherein the amino acid sequence of each of peptide STT543pep1, peptide STT543pep2, peptide STT543pep3, peptide STT543pep4, peptide STT543pep5, peptide STT543pep6, peptide STT543pep7, and peptide STT543pep8 has substantial identity, or is identical, to the corresponding region in SEQ ID NO: 98.

TABLE 7

Peptides defining the STT543 polypeptide

| | Amino acid position in Seq ID No.: 98 | | Length - No. amino acids |
|---|---|---|---|
| | First | Last | |
| STT543pep1 | 47 | 65 | 19 |
| STT543pep2 | 85 | 94 | 10 |
| STT543pep3 | 104 | 117 | 14 |
| STT543pep4 | 163 | 183 | 21 |
| STT543pep5 | 191 | 292 | 102 |
| STT543pep6 | 196 | 232 | 37 |
| STT543pep7 | 238 | 257 | 20 |
| STT543pep8 | 261 | 292 | 32 |

1.8 Decreased Expression of a Polypeptide (STT793) Having SEQ ID NO: 106, or an Ortholog or Paralog Thereof, in a Plant or Woody Plant In one embodiment, decreased expression of a polypeptide having SEQ ID NO: 106, or an ortholog or paralog thereof, in a GM plant or woody plant confers enhanced growth when compared to a non-GM plant or woody plant used as control, as measured as the height, and diameter and volume of the plant; as well as enhanced wood density (see example 8). Functional properties assigned to the expressed polypeptide are those of a small GTP-binding protein, which is involved in cellular signal transduction.

In one embodiment, the amino acid sequence of the polypeptide, whose expression is decreased, has at least 70% sequence identity to SEQ ID NO 8, and is selected from among SEQ ID NO: 106 (corresponding to *Populus trichocarpa* Potri.004G153400); SEQ ID NO: 108 (corresponding to *Populus trichocarpa* polypeptide encoded by gene Potri.009G115000.1); SEQ ID NO: 110 (corresponding to *Populus trichocarpa* polypeptide encoded by gene Potri.003G053400.1); SEQ ID NO: 112 (corresponding to *Populus trichocarpa* polypeptide encoded by gene Potri.001G182900.1); SEQ ID NO:114 (corresponding to *Eucalyptus grandis* polypeptide encoded by gene Eucgr.G00442.1); SEQ ID NO:116 (corresponding to *Eucalyptus grandis* polypeptide encoded by gene Eucgr.F03029.1); SEQ ID NO:118 (corresponding to a *Eucalyptus grandis* polypeptide encoded by gene Eucgr.J02962.1); SEQ ID NO:120 (corresponding to a *Eucalyptus grandis* polypeptide encoded by gene Eucgr.C03821.1); SEQ ID NO: 122 (corresponding to an *Arabidopsis thaliana* polypeptide encoded by gene AT3G18820); SEQ ID NO: 124 (corresponding to an *Arabidopsis thaliana* polypeptide encoded by gene AT1G49300.2); and SEQ ID NO:126 (corresponding to an *Arabidopsis thaliana* polypeptide encoded by gene AT3G16100.1).

In a preferred embodiment a polypeptide having at least 70% sequence identity to SEQ ID NO: 106, whose expression is reduced in a GM plant or woody plant to enhance growth when compared to a non-GM plant or woody plant used as control, is characterised by comprising all of the peptides listed in Table 8, wherein the amino acid sequence of each of peptide STT793pep1, peptide STT793pep2, peptide STT793pep3, peptide STT793pep4, and peptide STT793pep5 has substantial sequence identity, or is identical, to the corresponding region in SEQ ID NO: 106.

TABLE 8

Peptides defining the STT793 polypeptide

| | Amino acid position in Seq ID No.: 106 | | Length - No. |
|---|---|---|---|
| | First | Last | amino acids |
| STT793pep1 | 4 | 29 | 26 |
| STT793pep2 | 32 | 49 | 18 |
| STT793pep3 | 58 | 91 | 34 |
| STT793pep4 | 110 | 142 | 33 |
| STT793pep5 | 145 | 161 | 17 |

1.9 Decreased Expression of a Polypeptide (STT795) Having SEQ ID NO: 128, or an Ortholog or Paralog Thereof, in a Plant or Woody Plant In one embodiment, decreased expression of a polypeptide having SEQ ID NO: 128, or an ortholog or paralog thereof, in a GM plant or woody plant confers enhanced growth when compared to a non-GM plant or woody plant used as control, as measured as the height, and diameter and volume of the plant; as well as enhanced wood density (see example 9). Functional properties assigned to the expressed polypeptide are those of a calcium-binding protein with an EF-hand motif.

In one embodiment, the amino acid sequence of the polypeptide, whose expression is decreased, has at least 70% sequence identity to a sequence selected from among SEQ ID NO: 128 (corresponding to *Populus trichocarpa* Potri.002G008600); SEQ ID NO: 130 (corresponding to *Populus trichocarpa* Potri.T102700.1); SEQ ID NO: 132 (corresponding to *Populus trichocarpa* Potri.005G253000.1); SEQ ID NO:134 (corresponding to a *Eucalyptus grandis* polypeptide encoded by gene Eucgr.F01786.1); SEQ ID NO: 136 (corresponding to an *Arabidopsis thaliana* polypeptide encoded by gene AT1G20760.1); and SEQ ID NO: 138 (corresponding to an *Arabidopsis thaliana* polypeptide encoded by gene AT1G21630.1).

In a preferred embodiment a polypeptide having at least 55% sequence identity to SEQ ID NO: 128, whose expression is reduced in a GM plant or woody plant to enhance growth when compared to a non-GM plant or woody plant used as control, is characterised by comprising all of the peptides listed in Table 9, wherein the amino acid sequence of each of peptide STT795pep1, peptide STT795pep2, peptide STT795pep3, peptide STT795pep4, STT795pep5, STT795pep6, peptide STT795pep7, peptide STT795pep8, peptide STT795pep9, and peptide STT795pep10 has substantial sequence identity, or is identical, to the corresponding region in SEQ ID NO: 128.

TABLE 9

Peptides defining the STT795 polypeptide

| | Amino acid position in Seq ID No.: 128 | | Length - No. |
|---|---|---|---|
| | First | Last | amino acids |
| STT795pep1 | 5 | 95 | 91 |
| STT795pep2 | 9 | 52 | 44 |
| STT795pep3 | 56 | 106 | 51 |
| STT795pep4 | 246 | 268 | 23 |
| STT795pep5 | 249 | 268 | 20 |
| STT795pep6 | 512 | 547 | 36 |
| STT795pep7 | 557 | 587 | 31 |
| STT795pep8 | 645 | 673 | 29 |
| STT795pep9 | 769 | 790 | 22 |
| STT795pep10 | 899 | 919 | 21 |

2.0 Methods for Genetically Modifying the Expression of a Polypeptide in a Woody Plant of the Invention 2.1 Genetic Constructs and Methods for Enhancing Expression of a Polypeptide in a Plant or Woody Plant of the Invention A nucleic acid molecule having a nucleic acid sequence encoding a polypeptide whose expression is to be enhanced in a plant or woody plant (see 1.1-1.3), may be produced synthetically. The sequence of the nucleic acid molecule will comprise a coding sequence for the respective polypeptide; and whose nucleotide sequence is preferably optimised for expression in the respective plant or woody plant. An example of a suitable nucleic acid molecule encoding a polypeptide for enhanced expression in a plant or woody plant according to the invention is provided in the sequence listing. The nucleic acid molecule, encoding a polypeptide for use in the invention, is operably linked (fused) to cis-regulatory regions comprising a promoter nucleic acid molecule and preferably also a terminator nucleic acid molecule. The promoter may, for example, be a constitutive promoter (e.g. CaMV 35S promoter) or a plant promoter of the native plant gene encoding the polypeptide of the invention, or a tissue specific promoter. The terminator nucleic acid molecule may be a CaMV 35S terminator.

A nucleic acid molecule, encoding a polypeptide for use in the invention, operably linked to cis-regulatory regions, is introduced into a nucleic acid construct (vector) to ensure efficient cloning in *E. coli* or *Agrobacterium* strains, and which make it possible to stably transform plants. Such vectors include various binary and co-integrated vector systems, which are suitable for T-DNA-mediated transformation. The vector systems are generally characterized by having at least the vir genes, which are required for *Agrobacterium*-mediated transformation, and T-DNA border sequences 2.2 Genetic Constructs and Methods for Reducing Expression of a Polypeptide in a Plant or Woody Plant of the Invention The following methods serve to illustrate alternative means for down-regulating or silencing the functional activity of polypeptide (STT153, STT258, STT387, STT543, STT793 and STT795 or an ortholog or paralog thereof, as defined in 1.4-1.9) in a plant cell of a plant or woody plant, where the polypeptide is encoded by a nucleic acid molecule in the genome of the plant cell.

Antisense Transgenes for Silencing Expression of a Polypeptide

Down-regulating or silencing expression of either a naturally occurring gene expressing a polypeptide according to the invention (STT153, STT258, STT387, STT543, STT793 and STT795) or an ortholog or paralog thereof (as defined in 1.4-1.9), in a host plant can be obtained by transforming a transgene comprising a nucleic acid molecule (as defined in 1.5 to 1.8) encoding said polypeptide or a part thereof, or a molecule whose nucleic acid sequence is the anti-sense sequence of a nucleic acid molecule encoding said polypeptide or a part thereof, into the host plant.

RNAi Transgenes for Silencing Expression of a Polypeptide

Down-regulating or silencing expression of a naturally occurring gene encoding a polypeptide according to the invention (STT153, STT258, STT387, STT543, STT793 and STT795 or an ortholog or paralog thereof, as defined in 1.5-1.8) in a host plant can be obtained by "RNA interference" or "RNAi": RNAi employs a double-stranded RNA molecule or a short hairpin RNA to change the expression of a nucleic acid sequence with which they share substantial or total homology.

Suppression of the naturally occurring gene by RNA interference can be achieved using a transgene comprising a nucleic acid molecule functioning as a promoter that is operably linked to a nucleic acid molecule comprising a sense and anti-sense element of a segment (fragment) of genomic DNA or cDNA of the naturally occurring gene (comprising a nucleic acid molecule as defined above section 1). The sense and anti-sense DNA components can be directly linked or joined by an intron or artificial DNA segment that can form a loop when the transcribed RNA hybridizes to form a hairpin structure.

It may be preferable that there is complete sequence identity in the sequence used for down-regulation of expression of a target sequence, and the target sequence, although total complementarity or similarity of sequence is not essential. One or more nucleotides per 25 nucleotides of a given nucleic acid molecule may differ from the corresponding sequence in the target gene. Thus, a sequence employed in a down-regulation of gene expression in accordance with the present invention may be a wild-type sequence (e.g. gene) selected from those available, or a variant of such a sequence, such as ortholog or paralog genes of the presented genes.

It is important to note that there are a large number of fragments with a length of 20 nucleotides that will function in an RNA interference process to reduce the expression or activity of a target gene. As an example, for the gene STT153, which is 468 nucleotides long, some 448 different 20 nucleotide long fragments exists, and it is expected that most of these 20 nucleotide long fragments will reduce the expression or activity of the target gene by the RNA interference process. From a practical point-of-view, the interfering RNA molecule must be double stranded molecule, which can be achieved by cloning the fragment of interest head-to-head or tail-to-tail forming an inverted repeated sequence. Furthermore, the cloned DNA fragment forming the interfering RNA should be at least 17, 18, 19, 20, 21, 22, 23, 24 or 25 nucleotides long. The cloned DNA fragment forming the interfering RNA may also be 50, 100, 150, 200, 250, 300, 350, 400, 450, 500, 550, 600 or 650 up to the full length nucleotides long. The cloned DNA fragment forming the interfering RNA may be longer than the translated part of the mRNA of the gene. The present invention shows that both shorter DNA fragments and longer DNA fragments function unexpectedly well in the RNA interference process to reduce the expression or activity of a target gene, see Table 11.

Artificial microRNA for Silencing Expression of a Polypeptide

In another example, an artificial microRNA is constructed were a promoter drives the expression of an RNA molecule mimicking the function of a microRNA and the sequence setting the gene specificity is recombinantly introduced. In a particular embodiment of the present invention the nucleic acid construct, or recombinant DNA construct, further comprises a strong constitutive promoter in front of a transcribed cassette consisting of part of the target gene followed by a plant functional intron followed by the same part of the target gene in reverse orientation. The transcribed cassette is followed by a terminator sequence. The preferred vector is of such type wherein one of the nucleotide sequence of the invention is inserted in inverted repeat orientation.

Induced Mutation and TILLING for Modifying Expression of a Polypeptide

The down-regulation or silencing of expression of a polypeptide according to the invention (STT153, STT258, STT387, STT543, STT793 and STT795 or an ortholog or paralog thereof, as defined in 1.5-1.8) in a plant or woody plant cell can be obtained by means of mutations, such as point mutations, in the genes encoding the polypeptides.

Mutations can be introduced randomly into the genome of a plant cell, and then mutagenized plant cells can be selected by specific methods such like TILLING (Targeting Induced Local Lesions IN Genomes). Plants and plant cells, in which expression of a respective gene is down-regulated or silenced as the result of a chemically induced mutation in their genome, are to be considered to be "genetically modified", and since they do not comprise a transgene introduced into their genome they are not considered to be recombinant plants or plant cells.

T-DNA Insertion in a Gene for Silencing Expression of a Polypeptide

Down-regulation or silencing of expression of a gene encoding a polypeptide according to the invention (STT153, STT258, STT387, STT543, STT793 and STT795 or an ortholog or paralog thereof, as defined in 1.5-1.8), in a plant cell can also be obtained by T-DNA mutagenesis, whereby the T-DNA is used to randomly introduce mutations in the plant genome followed by selecting plants comprising (non-silent) silencing mutations in the endogenous genes. The plant, or plant cell, in which either the endogenous gene is mutated can later be identified by PCR or other high throughput technologies using a series of PCR primer pairs spanning the respective gene.

Site Directed Mutagenesis for Modifying the Expression of a Polypeptide.

Modifying the expression of a gene encoding a polypeptide according to the invention (STT153, STT258, STT387, STT543, STT793 and STT795 or an ortholog or paralog thereof, as defined in 1.1-1.9), can be performed by mutating parts of the gene regulatory sequences using the site-directed mutagenesis method of site-directed nucleases. Three such different technologies are Talen's, engineered Zinc finger nucleases and Crisper-cas. The basic mechanism is to modify the nuclease such that it is directed to a unique or near unique target DNA sequence in the target gene, the technology is then introduced into the cell and the nuclease will cut at or near the target sequence, the plants own DNA repair mechanism will then repair the cut DNA and in doing so a mutation will be produced in some cases. Individual plants with the mutation will then be identified and the selected plants will be tested for the desired effect, e.g. increased biomass production.

2.3 Methods for Introducing Genetic Constructs into a Plant or Woody Plant by Transformation Transformation of Plant Cells In accordance with the present invention, the method comprises transforming regenerable cells of a plant with a nucleic acid construct or recombinant DNA construct (as described in 2.1 and 2.2) and regenerating a transgenic plant from said transformed cell. Production of stable, fertile transgenic plants is now a routine method. Various methods are known for transporting the construct into a cell to be transformed. *Agrobacterium*-mediated transformation is widely used by those skilled in the art to transform tree species, in particular hardwood species such as poplar and *Eucalyptus*. Other methods, such as microprojectile or particle bombardment, electroporation, microinjection, direct DNA uptake, liposome mediated DNA uptake, or the vortexing method may be used where *Agrobacterium* transformation is inefficient or ineffective, for example in some gymnosperm species.

A person of skill in the art will realise that a wide variety of host cells may be employed as recipients for the DNA constructs and vectors according to the invention. Non-limiting examples of host cells include cells in embryonic tissue, callus tissue type I, II, and III, hypocotyls, meristem, root tissue, tissues for expression in phloem, leaf discs, petioles and stem internodes. Once the DNA construct or vector is within the cell, integration into the endogenous genome can occur.

Selection of Transformed Plant Cells and Regeneration of Plant or Woody Plants

Following transformation, transgenic plants are preferably selected using a dominant selectable marker incorporated into the transformation vector. Typically, such a marker will confer antibiotic or herbicide resistance on the transformed plants and selection of transformants can be accomplished by exposing the plants to appropriate concentrations of the antibiotic or herbicide. A selection marker using the D-form of amino acids and based on the fact that plants can only tolerate the L-form offers a fast, efficient and environmentally friendly selection system.

Subsequently, a plant may be regenerated, e.g. from single cells, callus tissue or leaf discs, as is standard in the art. Almost any plant can be entirely regenerated from cells, tissues and organs of the plant. After transformed plants are selected and they are grown to maturity and those plants showing altered growth properties phenotype are identified.

2.4 Methods for Detecting Modified Expression of a Gene Encoding a Polypeptide in a Plant or Woody Plant of the Invention Real-time RT-PCR can be used to compare gene expression, i.e. the mRNA expression, levels in a GM plant or woody plant with the corresponding non-GM plant or woody plant. The amount of the polynucleotides disclosed herein can be determined by analysing using Northern blots, sequencing, RT-PCR or microarrays.

Western blots with immune detection or gel shift assays can be used to measure the expression levels or amounts of a polypeptide expressed in a GM woody plant of the invention. Antibodies raised to the respective polypeptide may be used for specific immune-detection of the expressed polypeptide in tissue derived from a woody plant.

3.0 A Genetically Modified Plant or Woody Plant of the Invention

A GM plant or woody plant having increased growth; whereby the plant or woody plant product yields increased biomass and/or increased wood density, is characterised by an altered expression level of one or more polypeptide, wherein the polypeptide has an amino acid selected from among STT74, STT681, STT632, STT153, STT258, STT387, STT543, STT793, and STT795 having SEQ ID NO: 1-18 respectively, or an ortholog or paralog thereof (as defined in section 1.0).

In one embodiment, the GM woody plant is a tree; for example a hardwood plant selected from the group consisting of acacia, *eucalyptus*, hornbeam, beech, mahogany, walnut, oak, ash, willow, hickory, birch, chestnut, poplar, alder, maple, sycamore, ginkgo, a palm tree and sweet gum.

In another embodiment, the GM woody plant belongs to the family Myrtaceae and the family Salicaceae. Hardwood plants from the Salicaceae family, such as willow, poplar and aspen including variants thereof, are of particular interest, as these two groups include fast-growing species of tree or woody shrub which are grown specifically to provide timber and bio-fuel. *Eucalyptus* species are also examples of such fast growing trees.

In another embodiment, the GM woody plant is a conifer, for example a conifer selected from the group consisting of cypress, Douglas fir, fir, *sequoia*, hemlock, cedar, juniper, larch, pine, redwood, spruce and yew. In an alternative embodiment, the GM woody plant is a fruit bearing plant for example one selected from the group consisting of apple, plum, pear, banana, orange, kiwi, lemon, cherry, grapevine and fig. In an alternative embodiment, the GM woody plant is selected from the group consisting of cotton, bamboo and rubber plants.

In yet a further embodiment, the invention provides the use of the genes STT74, STT681, STT632, STT153, STT258, ST387, STT543, STT793, and STT795 as candidate genes in marker assisted breeding.

4.0 Methods for Measuring Enhanced Growth, Wood Density and Biomass Yield in a Plant or Woody Plant The increased growth might be measured by the height, diameter and stem volume. The density can be calculated and might be used as measurement for the quality of the wood. As illustrated in the examples below, the height of a GM woody plant of the invention was increased between 6 and 15% compared to non-GM trees; and the diameter of the GM woody plant was increased between 2% to 22% compared to non-GM trees. The increased stem volume was increased from between 3% and 73% in GM trees compared to non-GM trees. The increased wood density was increased from between 1% and 15% of the stem density compared to non-GM trees. A summary of the improved growth properties is found in Table 13 in the examples below. To verify that no changes of wood quality had occurred in the modified trees, wood from trees was analysed with FTIR. The data was evaluated using a multivariate analysis tool; and no significant differences were noted. In summary, growth properties can be improved without any loss in wood quality.

EXAMPLES

Methodology: cloning, transformation, establishment of the expression levels, identification of ortholog genes and calculation of growth properties are detailed below.

I Choice of Genes and Selection of Orthologs

Candidate genes for use in changing and/or modifying the phenotype of a plant with regard to growth were extracted from data derived from the genome sequencing of *Populus trichocarpa*. The selected genes (Table 10) were compared to, and in some instances corrected based on the sequence of homologous genes in *Arabidopsis thaliana* and other plant species.

TABLE 10

Summary of genes, the corresponding nucleotide and protein sequences and given construct names used in the invention.

| Gene | Amino acid SEQ ID No. | Nucleotide SEQ ID No. | Plasmid Construction |
| --- | --- | --- | --- |
| STT74 | SEQ ID No. 2 | SEQ ID No. 1 | 35s022 |
| STT681 | SEQ ID No. 28 | SEQ ID No. 27 | TFSTT052 |
| STT632 | SEQ ID No. 38 | SEQ ID No. 37 | TF0137 |
| STT153 | SEQ ID No. 58 | SEQ ID No. 57 | KR458 |
| STT258 | SEQ ID No. 74 | SEQ ID No. 73 | KR546 |
| STT387 | SEQ ID No. 88 | SEQ ID No. 87 | KR675 |
| STT543 | SEQ ID No. 98 | SEQ ID No. 97 | KR831 |
| STT793 | SEQ ID No. 106 | SEQ ID No. 105 | KR892 |
| STT795 | SEQ ID No. 128 | SEQ ID No. 127 | KR894 |

A method to identify putative orthologs and paralogs genes is to analyse the relationships between genes and their related genes in the same and different plants species. A commonly accepted and widely used method to achieve this is the construction of phylogenetic trees. The phylogenetic tree will reveal groupings of related proteins (clades) and depending on the algorithm used, it may also show evolutionary distances. Protein sequences for construction of trees are often picked from publicly available genomic resources, such as Phytozome and NCBI, using a BLAST search. Any given search will provide the user with a number of hits ordered by a score which is determined by sequence similarity over conserved regions of the protein sequences. To construct a robust tree it is common practice to include sequences from several related species. The number of hits varies greatly, depending on the query sequence and search parameters (settings). A score cut-off is determined individually for each search, usually by looking for significant drops in score/sequence similarity. It is important to also include genes that are closely related but that are not orthologous to your gene. All selected sequences are aligned using a multiple sequence alignment software such as ClustalW. The alignment can then be used to construct a phylogenetic tree using software for phylogenetic analysis such as MEGA. The phylogenetic tree will show a visual representation of the protein relationships of the corresponding genes. It can be expected that orthologs and paralogs will form distinct groups and thus be identified.

As an example, the above method was used to identify ortholog genes of 35s022 (STT74). For this example the databases searched were the *Populus trichocarpa* v3.0, *Eucalyptus grandis* v1, both parts of the Phytozome database, and *Arabidopsis thaliana* TAIR10 database. Homologous genes were selected from the above searches and further analysed. ClustalW was used as the alignment algorithm, and phylogenetic trees were constructed using MEGA and the neighbour joining method. From this analysis the following genes were identified as paralog and/or ortholog genes: AT4G05060, with amino acid sequence SEQ ID NO: 22; AT4G21450, with amino acid sequence SEQ ID NO: 24; AT5G54110, with amino acid sequence SEQ ID NO: 26; Eucgr.F01073, with amino acid sequence SEQ ID NO: 16; Eucgr.K00911, with amino acid sequence SEQ ID NO: 18; Eucgr.D00750, with amino acid sequence SEQ ID NO: 20; Potri.001G408200, with amino acid sequence SEQ ID NO: 8; Potri.004G033500, with amino acid sequence SEQ ID NO: 10; Potri.011G041900, with amino acid sequence SEQ ID NO: 12; Potri.011G126200, with amino acid sequence SEQ ID NO: 14; Potri.013G147800, with amino acid sequence SEQ ID NO: 4; and Potri.019G116400, with amino acid sequence SEQ ID NO: 6.

These genes were further analysed to identify the amino acid sequence identity levels of amino acid sub-sequences of the encoded polypeptides that could be used to define ortholog genes, compared to other homologous genes naturally occurring in plants and thereby created by evolution, based on amino acid identity. The regions selected for this were regions that showed a clear drop in identity level between genes that were identified as ortholog genes in the phylogenetic analysis compared to the genes that were identified as not being ortholog genes. The result of amino acid identity analysis showed that genes encoding a polypeptide comprising peptides which have higher than 75% sequence identity to amino acids 72-267 of SEQ ID NO 2 and higher than 80% identity to amino acids 84-153 of SEQ ID NO 2 and higher than 90% identity to amino acids 122-132 of SEQ ID NO 2 respectively, can be identified as ortholog genes encoding polypeptides orthologous to the polypeptide of SEQ ID NO 2. The result was then tested by identifying more orthologs of other species using the NCBI non-redundant protein sequence database and the identity levels above. These identified ortholog genes were then confirmed by adding them to the phylogenetic analysis.

II Cloning of a Gene for Expression of the STT74 Polypeptide

The gene, with the nucleic acid sequence SEQ ID No: 10, corresponding to *Populus trichocarpa* polypeptide encoded by gene POPTR_0019s13890, was cloned into an overexpression vector under the control of the CaMV 35S promoter, giving construct 35s022. To produce cDNA template, total RNA was isolated from stem, leaf and bark tissue sampled from hybrid aspen (*Populus tremula* x *tremuloides*) clone T89 plants and reverse transcribed to cDNA using Superscript III First Strand Synthesis System (Invitrogen). The gene STT74 was then amplified by PCR with gene specific forward and reverse primers using Phusion high fidelity DNA polymerase (Finnzymes). The amplified gene was subcloned into a Gateway entry vector (pDONR201) using BP recombination cloning (Invitrogen), followed by further subcloning into the binary over-expression vector pK2GW7 using Gateway LR recombination cloning (Invitrogen), where the gene was placed under the control of the CaMV 35S promoter. The cloned gene was verified using restriction digest of the final pK2GW7 vector with insert.

III Cloning of Genes for Expression of STT632 and STT681 Polypeptides

The cDNA was obtained as described above. The transcription factor genes were amplified from cDNA and subcloned into a Gateway entry vector (pENTR/D-TOPO) by TOPO cloning (Invitrogen), followed by further subcloning of the genes into the binary over-expression vector pK2GW7 using Gateway LR recombination cloning system (Invitrogen), where the genes were placed under the control of the CaMV 35S promoter. The plasmid construct TFSTT052 contains the gene STT681 with the nucleic acid sequence SEQ ID No: 27, which corresponds to the similar *Populus trichocarpa* gene, POPTR_0001s38090 (v3.0 updated to Potri.001G37200).

The plasmid construct TF0137 contains the gene STT632 with the nucleic acid sequence SEQ ID No: 37; which correspond to POPTR_0013s14960 (v3.0 updated to Potri.013G153400) gene, in *Populus trichocarpa*. The cloned genes were 5' and 3' end sequenced and verified using standard techniques before subsequent subcloning into the pK2GW7 vector.

IV Cloning Gene Fragments for Preparing RNAi Constructs

A fragment of each of the selected genes listed in Table 11, encoding STT153, STT258, ST387, ST543, STT793, and STT795, was identified located in a region of low homology to related genes in order to increase RNAi specificity. Gene-specific primers were designed from EST sequence data to amplify the gene fragments. EST library clones were used as template for PCR amplification. The amplified gene fragment was subcloned into a Gateway entry vector (pDONR201) using BP recombination cloning (Invitrogen), followed by subsequent subcloning into the binary RNA interference vector pK7GWIWG2(I) using Gateway LR recombination cloning (Invitrogen) according to manufacturer's recommendations. A final RNAi construct can be schematically described: [CaMV 35S promoter]–[gene fragment (antisense direction)]–[intron]–[gene fragment (sense direction)]–[35S terminator]. When transcribed the inverted repeats separated by the intron will form a double stranded hairpin shaped RNA molecule. The constructs were verified using restriction enzyme digest of the final pK7GWIWG2(I) vector with insert.

TABLE 11

Fragments used for RNAi constructs

| Gene | Sequence of cloned RNAi fragment | Length of cloned RNAi fragment |
| --- | --- | --- |
| STT153 | SEQ ID No. 139 | 515 |
| STT258 | SEQ ID No. 140 | 313 |
| STT387 | SEQ ID No. 141 | 254 |
| STT543 | SEQ ID No. 142 | 258 |
| STT793 | SEQ ID No. 143 | 274 |
| STT795 | SEQ ID No. 144 | 261 |

Further details of each RNAi construct are as follows:

IVi RNAi Construct (KR458) for Reducing Expression of STT153

Two copies of a 515 nucleotide long DNA fragment, SEQ ID No: 139, was inserted, as an inverted repeat in plasmid construct KR458. This fragment originates from a hybrid aspen cDNA from the EST clone UB11CPC10. The gene down-regulated by the RNAi construct KR458 in poplar corresponds to the gene POPTR_0018s01490 (v3.0 updated to Potri.018G029900) encoding the polypeptide of SEQ ID NO: 58 in the closely related *Populus trichocarpa*.

IVii RNAi Construct (KR546) for Reducing Expression of STT258

Two copies of a 313 nucleotide long DNA fragment, SEQ ID No: 140, was inserted, as an inverted repeat in plasmid construct KR546. This fragment originates from a hybrid aspen cDNA from the EST clone G079P71. The gene down-regulated by the RNAi construct KR546 in poplar corresponds to the gene POPTR_0013s13090, (or v3.0 updated to Potri.013G127200, encoding the polypeptide of in the closely related *Populus trichocarpa* having SEQ ID No: 74.

IViii RNAi Construct (KR675) for Reducing Expression of STT387

Two copies of a 254 nucleotide long DNA fragment, SEQ ID No: 141, was inserted, as an inverted repeat in plasmid construct KR675. This fragment originates from a hybrid aspen cDNA from the EST clone A044P01. The gene down-regulated by the RNAi construct KR675 in poplar corresponds to the gene Potri.013G029900 gene, encoding the polypeptide of SEQ ID No.: 88 in the closely related *Populus trichocarpa*.

IViv RNAi Construct (KR831) for Reducing Expression of STT543

Two copies of a 254 nucleotide long DNA fragment, SEQ ID No: 142, was inserted, as an inverted repeat in plasmid construct KR831. This fragment originates from a hybrid aspen cDNA from the EST clone F129P33. The gene down-regulated by the RNAi construct KR831 in poplar corresponds to the gene Potri.009G107600 encoding the polypeptide of SEQ ID No: 98 in the closely related *Populus trichocarpa*.

IVv RNAi Construct (KR892) for Reducing Expression of STT793

Two copies of a 274 nucleotide long DNA fragment, SEQ ID No: 143, was inserted, as an inverted repeat in plasmid construct KR892. This fragment originates from a hybrid aspen cDNA from the EST clone UB30CPG09. The gene down-regulated by the RNAi construct KR892 in poplar corresponds to the gene Potri.004G153400 encoding the polypeptide of SEQ ID No: 106, in the closely related *Populus trichocarpa*.

IVvi RNAi Construct (KR894) for Reducing Expression of STT795

Two copies of a 261 nucleotide long DNA fragment, SEQ ID No: 144, was inserted, as an inverted repeat in plasmid construct KR894. This fragment originates from a hybrid aspen cDNA from the EST clone UB30CPG09. The gene down-regulated by the RNAi construct KR894 in poplar corresponds to the gene Potri.002G008600 encoding the polypeptide of SEQ ID No: 128, in the closely related *Populus trichocarpa*.

V Plant Transformation

DNA constructs were transformed into *Agrobacterium* and subsequently into Hybrid aspen, where *Populus tremula x tremuloides* clone T89, also called "poplar", was transformed and regenerated. Approximately 3-8 independent lines were generated for each construct. One such group of transgenic trees produced using one construct is hereafter called a "construction group", e.g. different transgenic trees emanating from one construct.

Each transgenic line within each construction group derives from a different transformation event and has most probably the recombinant DNA inserted into a unique location in the plant genome. This makes the different transgenic lines within one construction group partly different. For example it is known that different transformation events will produce plants with different expression levels of the gene product. It is also known that different levels of expression of a gene will result in different levels of phenotypic effects.

VI Plant Growth

The transgenic poplar lines were grown together with their wild-type control (wt) trees, in a greenhouse under a photoperiod of 18 h and a temperature of 22° C./15° C. (day/night). The plants were fertilized weekly. The plants were grown for 8-9 weeks before harvest. During this time their height and diameter was measured one to two times per week. In a growth group a number of wild-type trees (typically 35-45 trees) and a number of transgenic trees comprising several construction groups (typically 6-20 construction groups) were grown in parallel in the greenhouse under the same conditions. All comparisons between the wild-type trees and construction groups are made within each cultivation group.

VII Growth Analyses

To identify construction groups showing a significant difference compared to the wild type population, data from each construction group was subjected to a number of growth data analyses of growth/biomass and wood density measurements.

After 8 to 9 weeks growth in the greenhouse the trees were harvested and sampled. Two principal types of harvests were used; either a general setup designed for e.g. chemical analysis, wood morphology analysis, gene expression analysis, wood density analysis and metabolomics analysis, or a second setup designed for dry weight measurements of bark, wood, leafs and roots.

Measurements of plant height and diameter were recorded one to two times per week during the cultivation and before harvest of the plants. Final height and diameter measurements were subsequently used to identify construction groups with altered growth characteristics.

The volume of the stem of each individual plant was approximated from final height and final diameter measurements using the formula for volume of a cone.

Stem volume approximation:

$$V = \frac{\pi * r^2 * h}{3}$$

where: V=Volume; h=height (Final height), r=radius (Final diameter/2) Average final volumes of each construction group population and corresponding wild type population were subsequently calculated.

VIII Replanting and Re-Growing

In order to verify data reproducibility and for further analysis, all or a subset of construction groups lines with growth characteristics of extra interest were selected based on growth data from the first cultivation in the greenhouse, replanted and regrown under the same conditions as in the first greenhouse cultivation. All selected transgenic poplar lines were regrown in triplicates. Suffix denoting replant round and transgenic line replicate were added to the names of the construction group transgenic lines in order to keep them unique.

IX Wood Density Analyses

Wood density is an important trait for increasing biomass production. An increase in wood density increases the energy content per cubic metre reduces the volume of a fixed amount of biomass and hence, e.g. the volume required to transport a fixed amount of biomass. Correspondingly, more biomass can be transported per volume. Therefore increased density is of interest, even if total biomass is not increased. Increased density could also be of benefit coupled to pulp and paper production.

A 5 cm long stem segment, sampled between 36 and 41 cm from the soil from each harvested plant and stored in a freezer (−20° C.) after harvest, was used for density measurements. Samples to be analysed were thawed followed by removal of bark and pith. The weight (w) was measured using a balance and the volume (V) was determined using the principle of Archimedes, where wood samples were submerged (using a needle) into a beaker (placed on a balance) with water. The recorded increase in weight is equivalent to the weight of the water pushed aside by the wood sample. Since the density of water is 1 g/cm$^3$ it is also equivalent to the volume of the wood samples. The samples were then dried in oven for >48 h at 60° C.

The dry weights (dw) were measured and the density (d) was calculated according to:

$$d = \frac{dw}{V}$$

Samples from each construction group were compared to wild type samples from the same cultivation.

X Analysis of Expression Levels

Real-time RT-PCR was used to compare construct gene expression levels of the construction group with corresponding wild type group. The expression level of 26S proteasome regulatory subunit S2 was used as a reference to which construct gene expression was normalized. The comparative CT method was used for calculation of relative construct gene expression level, where the ratio between construction and reference gene expression level is described by $(1+E_{target})-CT_{target}/(1+E_{reference})-CT_{reference}$, where $E_{target}$ and $E_{reference}$ are the efficiencies of construct and reference gene PCR amplification respectively and $CT_{target}$ and $CT_{reference}$ are the threshold cycles as calculated for construct and reference gene amplification respectively.

The mRNA expression levels of the up- or down-regulated gene in each of the transformed lines is summarized in Table 12.

TABLE 12

Summary of mRNA expression levels.

| Gene | Construct used in transformation | Steady-state level of mRNA transcript of corresponding regulated gene in transformed lines as compared to wild type control (by RT-PCR) |
|---|---|---|
| Over-expression constructs ||| 
| STT74 | 35s022 | 16.5 to 95 times higher |
| STT681 | TFSTT052 | 9.9 to 38 times higher |
| STT632 | TF0137 | 1.5 to 1.8 times higher |
| Down-regulated expression constructs ||| 
| STT153 | KR458 | 42.3% to 85.7% |
| STT258 | KR546 | 6.5% to 97.5% |
| STT387 | KR675 | 37.0% to 74.4% |
| STT543 | KR831 | 7.0% to 66.2% |
| STT793 | KR892 | 18.2% to 94.1% |
| STT795 | KR894 | 33.6% to 35.1% |

XI Results from Greenhouse Tests

The genes/constructs/construction groups were analysed as described above. Data from the transgenic trees transformed with the selected genes are presented in the examples below, with growth and wood property characteristics. For some construction groups the wood density has been measured and for some construction groups density predictions have been made based on FT-IR analysis (see table headers).

It is noted here, and applies to all the following data, that the ratio between the transgenic and wild type populations shows the average difference between those groups of plants. However, it does not generally show the full potential of modifying the expression of the gene. This is because the calculations are based on different transgenic events.

For an easy overview, the improved growth properties of transgenic *Populus tremula* x *tremuloides* clone T89 plant, transformed with the plasmid constructs in Table 10, causing enhanced or reduced expression of the protein encoded by the respective gene, are summarised in Table 13. The percentage values are the ratio between the analysed construct and the wild type tree from the examples below.

TABLE 13

Summary of improved growth properties of GM woody plants. The presented values are the average for all the tested lines per construct. Best performing lines are probably better.

| Gene | Construct used in transformation | Height | Diameter | Volume | Density |
|---|---|---|---|---|---|
| Over-expression constructs | | | | | |
| STT74 | 35s022 | 107-124% | 102-122% | 113-173% | 115% |
| STT681 | TFSTT052 | 106% | 100% | 103% | 115% |
| STT632 | TF0137 | 115% | 101% | 119% | 106% |
| Down-regulated expression constructs | | | | | |
| STT153 | KR458 | 109% | 110% | 131% | N.D. |
| STT258 | KR546 | 116% | 108% | 135% | 96% |
| STT387 | KR675 | 108-111% | 101-121% | 108-159% | 100-102% |
| STT543 | KR831 | 105% | 104% | 114% | 111% |
| STT793 | KR892 | 106% | 108% | 123% | 110% |
| STT795 | KR894 | 107% | 108% | 124% | 101% |

The growth results for modulation of the expression of each gene in a woody plant are presented separately as examples of the invention.

Example 1: STT74

The expression level of mRNA from the gene STT74 was analysed in different lines of the construct 35S022. The increased expression level was between 16.5 to 95 times higher than the wild type expression level when analysed with RT-PCR as described above.

The 35s022 construct has been cultured three times and produced transgenic trees with significantly improved height, diameter, stem-volume and density values.

In the first cultivation with height, diameter, stem volume and density increases of in average 15%, 22%, 73% and 15% respectively, compared to wild type trees.

In the second cultivation with a height increase of in average 14% compared to wild type trees.

In the third cultivation with height and stem volume increases of in average 12% and 25% respectively, compared to wild type trees.

Transgenic line 35s022BIO-1B has a height and stem volume increase of 10% and 25% respectively, compared to wild type trees.

Transgenic line 35s022BIO-2B has a height and stem volume increase of 24% and 46% respectively, compared to wild type trees.

| | | Height (cm) | Diameter (mm) | Volume (cm3) | Density (g/cm3) |
|---|---|---|---|---|---|
| 35s022 | Average | 147.2 | 9.6 | 36.0 | 0.314 |
| | Max | 157.0 | 10.9 | 47.9 | 0.366 |
| | Min | 133.0 | 7.9 | 22.7 | 0.265 |
| | STD | 10.0 | 1.2 | 9.2 | 0.043 |
| | Number | 5 | 5 | 5 | 5 |
| T89 | Average | 127.5 | 7.85 | 20.7 | 0.274 |
| | Max | 140.0 | 9.2 | 29.1 | 0.354 |
| | Min | 115.0 | 6.50 | 13.7 | 0.226 |
| | STD | 6.5 | 0.67 | 4.0 | 0.026 |
| | Number | 39 | 39 | 39 | 36 |
| | Upper limit | 140.6 | 9.2 | 28.8 | 0.326 |
| | Lower limit | 114.4 | 6.5 | 12.7 | 0.222 |
| Statistics | Ratio | 1.15 | 1.22 | 1.73 | 1.15 |
| | T-test (p-value) | 0.00000038 | 0.000012 | 0.000000032 | 0.0044 |
| | Number > Upper limit | 4 | 3 | 4 | 3 |
| | Number < Lower limit | 0 | 0 | 0 | 0 |
| | Score | (++) | (++) | (++) | (++) |
| Max/Avg | 35s022max/WTavg | 1.23 | 1.39 | 2.31 | 1.34 |
| 35s022BIO | Average | 136.1 | 9.5 | 32.4 | |
| | Max | 162.0 | 10.3 | 42.8 | |
| | Min | 112.0 | 8.5 | 20.9 | |
| | STD | 14.3 | 0.7 | 6.9 | |
| | Number | 13 | 13 | 13 | |
| T89 | Average | 121.4 | 8.98 | 25.8 | |
| | Max | 142.0 | 10.1 | 33.6 | |
| | Min | 107.0 | 7.85 | 17.7 | |

-continued

|  |  | Height (cm) | Diameter (mm) | Volume (cm3) | Density (g/cm3) |
|---|---|---|---|---|---|
|  | STD | 6.9 | 0.56 | 4.0 |  |
|  | Number | 33 | 33 | 33 |  |
|  | Upper limit | 135.5 | 10.1 | 33.9 |  |
|  | Lower limit | 107.4 | 7.8 | 17.7 |  |
| Statistics | Ratio | 1.12 | 1.05 | 1.25 |  |
|  | T-test (p-value) | 0.000025 | 0.016 | 0.00021 |  |
|  | Number > Upper limit | 7 | 2 | 6 |  |
|  | Number < Lower limit | 0 | 0 | 0 |  |
|  | Score | (++) | (+I) | (++) |  |
| Max/Avg | 35s022BIOmax/WTavg | 1.33 | 1.15 | 1.66 | 1.07 |
| 35s022BIO | Average | 130.2 | 9.2 | 29.2 |  |
| Line 1A | Max | 147.0 | 10.1 | 39.3 |  |
|  | Min | 118.0 | 8.5 | 22.2 |  |
|  | STD | 11.3 | 0.6 | 6.5 |  |
|  | Number | 5 | 5 | 5 |  |
| T89 | Average | 121.4 | 8.98 | 25.8 |  |
|  | Max | 142.0 | 10.1 | 33.6 |  |
|  | Min | 107.0 | 7.85 | 17.7 |  |
|  | STD | 6.9 | 0.56 | 4.0 |  |
|  | Number | 33 | 33 | 33 |  |
|  | Upper limit | 135.5 | 10.1 | 33.9 |  |
|  | Lower limit | 107.4 | 7.8 | 17.7 |  |
| Statistics | Ratio | 1.07 | 1.02 | 1.13 |  |
|  | T-test (p-value) | 0.02 | 0.44 | 0.11 |  |
|  | Number > Upper limit | 1 | 0 | 1 |  |
|  | Number < Lower limit | 0 | 0 | 0 |  |
|  | Score | (Normal) | (Normal) | (Normal) |  |
| 35s022BIO | Average | 133.4 | 9.6 | 32.4 |  |
| Line 1B | Max | 152.0 | 10.3 | 37.9 |  |
|  | Min | 112.0 | 8.5 | 20.9 |  |
|  | STD | 14.6 | 0.9 | 7.0 |  |
|  | Number | 5 | 5 | 5 |  |
| T89 | Average | 121.4 | 8.98 | 25.8 |  |
|  | Max | 142.0 | 10.1 | 33.6 |  |
|  | Min | 107.0 | 7.85 | 17.7 |  |
|  | STD | 6.9 | 0.56 | 4.0 |  |
|  | Number | 33 | 33 | 33 |  |
|  | Upper limit | 135.5 | 10.1 | 33.9 |  |
|  | Lower limit | 107.4 | 7.8 | 17.7 |  |
| Statistics | Ratio | 1.10 | 1.07 | 1.25 |  |
|  | T-test (p-value) | 0.004 | 0.047 | 0.0038 |  |
|  | Number > Upper limit | 3 | 2 | 3 |  |
|  | Number < Lower limit | 0 | 0 | 0 |  |
|  | Score | (++) | (+I) | (++) |  |
| 35s022BIO | Average | 150.3 | 9.8 | 37.7 |  |
| Line 2B | Max | 162.0 | 10.1 | 42.8 |  |
|  | Min | 139.0 | 9.3 | 31.1 |  |
|  | STD | 11.5 | 0.4 | 6.0 |  |
|  | Number | 3 | 3 | 3 |  |
| T89 | Average | 121.4 | 8.98 | 25.8 |  |
|  | Max | 142.0 | 10.1 | 33.6 |  |
|  | Min | 107.0 | 7.85 | 17.7 |  |
|  | STD | 6.9 | 0.56 | 4.0 |  |
|  | Number | 33 | 33 | 33 |  |
|  | Upper limit | 135.5 | 10.1 | 33.9 |  |
|  | Lower limit | 107.4 | 7.8 | 17.7 |  |
| Statistics | Ratio | 1.24 | 1.09 | 1.46 |  |
|  | T-test (p-value) | 0.00000014 | 0.026 | 0.000033 |  |
|  | Number > Upper limit | 3 | 0 | 2 |  |
|  | Number < Lower limit | 0 | 0 | 0 |  |
|  | Score | (++) | (Normal) | (++) |  |

Example 2: STT681

The expression level of mRNA from the gene STT681 was analysed in different lines of the construct TFSTT052. The increased expression level was 9.9 to 38 times of the wild type expression level when analysed with RT-PCR as described above.

The TFSTT052 construct has produced transgenic trees with a significant density increase of 15% compared to wild type trees.

|  |  | Height (cm) | Diameter (mm) | Volume (cm3) | Density (g/cm3) |
|---|---|---|---|---|---|
| TFSTT052 | Average | 136.3 | 9.2 | 30.8 | 0.326 |
|  | Max | 147.0 | 10.4 | 41.6 | 0.342 |
|  | Min | 114.0 | 7.4 | 16.1 | 0.286 |
|  | STD | 11.9 | 1.1 | 8.5 | 0.021 |
|  | Number | 6 | 6 | 6 | 6 |
| T89 | Average | 129.0 | 9.21 | 29.8 | 0.284 |
|  | Max | 151.0 | 11.4 | 51.0 | 0.361 |
|  | Min | 56.0 | 3.50 | 1.8 | 0.222 |
|  | STD | 14.0 | 1.32 | 8.4 | 0.030 |
|  | Number | 55 | 55 | 55 | 41 |
|  | Upper limit | 157.1 | 11.9 | 46.7 | 0.344 |
|  | Lower limit | 101.0 | 6.6 | 13.0 | 0.224 |
| Statistics | Ratio | 1.06 | 1.00 | 1.03 | 1.15 |
|  | T-test (p-value) | 0.22 | 0.96 | 0.79 | 0.0018 |
|  | Number > Upper limit | 0 | 0 | 0 | 0 |
|  | Number < Lower limit | 0 | 0 | 0 | 0 |
|  | Score | (Normal) | (Normal) | (Normal) | (+P) |
| Max/Avg | TFSTT052max/WTavg | 1.14 | 1.13 | 1.40 | 1.20 |

Example 3: STT632

The expression level of mRNA from the gene STT632 was analysed in different lines of the construct TF0137. The increased expression level was 1.5 to 1.8 times of the wild type expression level when analysed with RT-PCR as described above.

The TF0137 construct has produced transgenic trees with a significant height increase of in average 15% compared to wild type trees.

|  |  | Height (cm) | Diameter (mm) | Volume (cm3) | Density (g/cm3) |
|---|---|---|---|---|---|
| TF0137 | Average | 160.4 | 8.6 | 32.6 | 0.284 |
|  | Max | 200.0 | 9.6 | 47.8 | 0.332 |
|  | Min | 121.0 | 7.9 | 20.8 | 0.262 |
|  | STD | 37.1 | 0.8 | 13.7 | 0.028 |
|  | Number | 5 | 5 | 5 | 5 |
| T89 | Average | 139.7 | 8.56 | 27.3 | 0.268 |
|  | Max | 155.0 | 9.9 | 39.0 | 0.321 |
|  | Min | 122.0 | 7.40 | 18.6 | 0.238 |
|  | STD | 8.6 | 0.71 | 5.6 | 0.019 |
|  | Number | 40 | 39 | 36 | 42 |
|  | Upper limit | 157.1 | 10.0 | 38.7 | 0.306 |
|  | Lower limit | 122.3 | 7.1 | 15.9 | 0.229 |
| Statistics | Ratio | 1.15 | 1.01 | 1.19 | 1.06 |
|  | T-test p-value | 0.0032 | 0.85 | 0.12 | 0.081 |
|  | Number > Upper limit | 2 | 0 | 2 | 1 |
|  | Number < Lower limit | 1 | 0 | 0 | 0 |
|  | Score | (++) | (Normal) | (+I) | (Normal) |
| Max/Avg | TF0137max/WTavg | 1.43 | 1.12 | 1.75 | 1.24 |

Example 4: ST153

The expression level of mRNA from the gene STT153 was analysed in different lines of the construct KR458. The reduced expression level was 42.3% to 85.7% of the wild type expression level when analysed with RT-PCR as described above.

The KR458 construct has produced transgenic trees with significantly improved diameter and stem volume values, with diameter and stem volume increases of in average 10% and 31% respectively, compared to wild type trees.

|  |  | Height (cm) | Diameter (mm) | Volume (cm3) | Density (g/cm3) |
|---|---|---|---|---|---|
| KR458 | Average | 149.2 | 10.7 | 44.9 |  |
|  | Max | 156.0 | 11.7 | 54.5 |  |
|  | Min | 142.0 | 9.2 | 34.2 |  |
|  | STD | 4.8 | 0.9 | 7.4 |  |
|  | Number | 6 | 6 | 6 |  |
| T89 | Average | 136.6 | 9.75 | 34.3 |  |
|  | Max | 165.0 | 11.2 | 47.0 |  |
|  | Min | 109.0 | 8.10 | 22.0 |  |
|  | STD | 12.5 | 0.64 | 6.0 |  |
|  | Number | 38 | 38 | 38 |  |
|  | Upper limit | 162.0 | 11.0 | 46.5 |  |
|  | Lower limit | 111.2 | 8.5 | 22.1 |  |
| Statistcs | Ratio | 1.09 | 1.10 | 1.31 |  |
|  | T-test (p-value) | 0.021 | 0.0029 | 0.00034 |  |
|  | Number > Upper limit | 0 | 2 | 2 |  |
|  | Number < Lower limit | 0 | 0 | 0 |  |
|  | Score | (Normal) | (++) | (++) |  |
| Max/Avg | KR458max/WTavg | 1.14 | 1.20 | 1.59 |  |

Example 5: STT258

The expression level of mRNA from the gene STT258 was analysed in different lines of the construct KR546. The reduced expression level was 6.5% to 97.5% of the wild type expression level when analysed with RT-PCR as described above.

The KR546 construct has produced transgenic trees with significantly improved height and stem volume values, with height and stem volume increases of in average 16% and 35% respectively, compared to wild type trees.

|  |  | Height (cm) | Diameter (mm) | Volume (cm3) | Density (g/cm3) |
|---|---|---|---|---|---|
| KR546ReTrans | Average | 146.9 | 10.4 | 41.9 | 0.293 |
|  | Max | 160.0 | 11.8 | 56.5 | 0.336 |
|  | Min | 115.0 | 9.1 | 24.9 | 0.256 |
|  | STD | 14.4 | 0.8 | 8.9 | 0.029 |
|  | Number | 8 | 8 | 8 | 8 |
| T89 | Average | 127.1 | 9.56 | 31.0 | 0.304 |
|  | Max | 145.0 | 10.9 | 43.7 | 0.376 |
|  | Min | 104.0 | 6.55 | 11.7 | 0.232 |
|  | STD | 11.4 | 0.94 | 7.5 | 0.036 |
|  | Number | 32 | 32 | 32 | 28 |
|  | Upper limit | 150.3 | 11.5 | 46.2 | 0.378 |
|  | Lower limit | 103.9 | 7.6 | 15.8 | 0.231 |
| Statistcs | Ratio | 1.16 | 1.08 | 1.35 | 0.96 |
|  | T-test (p-value) | 0.00017 | 0.031 | 0.0011 | 0.42 |
|  | Number > Upper limit | 4 | 1 | 2 | 0 |
|  | Number < Lower limit | 0 | 0 | 0 | 0 |
|  | Score | (++) | (Normal) | (++) | (Normal) |
| Max/Avg | KR546ReTransmax/WTavg | 1.26 | 1.23 | 1.82 | 1.11 |

Example 6: STT387

The expression level of mRNA from the gene ST387 was analysed in different lines of the construct KR675. The reduced expression level was 37.0% to 74.4% of the wild type expression level when analysed with RT-PCR as described above.

The KR675 construct has been cultured two times and produced transgenic trees with significantly improved height, diameter and stem volume values.

In the first cultivation with height, diameter and stem volume increases of in average 11%, 21% and 59% respectively, compared to wild type.

In the second cultivation with a height increase of 8% compared to wild type trees.

|  |  | Height (cm) | Diameter (mm) | Volume (cm3) | Density (g/cm3) |
|---|---|---|---|---|---|
| KR675 | Average | 134.7 | 10.1 | 35.9 | 0.283 |
|  | Max | 150.0 | 10.5 | 42.5 | 0.308 |
|  | Min | 125.0 | 9.5 | 29.5 | 0.260 |
|  | STD | 10.1 | 0.5 | 5.2 | 0.022 |
|  | Number | 6 | 6 | 6 | 6 |
| T89 | Average | 121.1 | 8.33 | 22.6 | 0.283 |
|  | Max | 138.0 | 10.4 | 36.7 | 0.339 |
|  | Min | 103.0 | 5.65 | 8.9 | 0.227 |
|  | STD | 9.3 | 1.10 | 6.7 | 0.031 |
|  | Number | 32 | 32 | 32 | 26 |
|  | Upper limit | 140.1 | 10.6 | 36.4 | 0.347 |
|  | Lower limit | 102.0 | 6.1 | 8.9 | 0.219 |
| Statistics | Ratio | 1.11 | 1.21 | 1.59 | 1.00 |
|  | T-test (p-value) | 0.0026 | 0.0006 | 0.000057 | 0.97 |
|  | Number > Upper limit | 2 | 0 | 3 | 0 |
|  | Number < Lower limit | 0 | 0 | 0 | 0 |
|  | Score | (++) | (+P) | (++) | (Normal) |
| Max/Avg | KR675max/WTavg | 1.24 | 1.25 | 1.88 | 1.09 |
| KR675rp1 | Average | 150.5 | 8.6 | 29.4 | 0.269 |
|  | Max | 161.0 | 9.2 | 34.1 | 0.289 |
|  | Min | 139.0 | 7.8 | 21.9 | 0.251 |
|  | STD | 8.1 | 0.4 | 3.8 | 0.011 |
|  | Number | 11 | 8 | 8 | 11 |
| T89 | Average | 139.7 | 8.56 | 27.3 | 0.268 |
|  | Max | 155.0 | 9.9 | 39.0 | 0.321 |
|  | Min | 122.0 | 7.40 | 18.6 | 0.238 |
|  | STD | 8.6 | 0.71 | 5.6 | 0.019 |
|  | Number | 40 | 39 | 36 | 42 |
|  | Upper limit | 157.1 | 10.0 | 38.7 | 0.306 |
|  | Lower limit | 122.3 | 7.1 | 15.9 | 0.229 |
| Statistics | Ratio | 1.08 | 1.01 | 1.08 | 1.00 |
|  | T-test (p-value) | 0.00055 | 0.81 | 0.32 | 0.87 |
|  | Number > Upper limit | 3 | 0 | 0 | 0 |
|  | Number < Lower limit | 0 | 0 | 0 | 0 |
|  | Score | (++) | (Normal) | (Normal) | (Normal) |
| Max/Avg | KR675rp1max/WTavg | 1.15 | 1.07 | 1.25 | 1.08 |
| KR675rp1 | Average | 153.7 | 8.6 | 31.2 | 0.273 |

|  |  | Height (cm) | Diameter (mm) | Volume (cm3) | Density (g/cm3) |
|---|---|---|---|---|---|
| Line 3A | Max | 161.0 | 8.7 | 31.5 | 0.280 |
|  | Min | 141.0 | 8.6 | 30.8 | 0.270 |
|  | STD | 11.0 | 0.0 | 0.5 | 0.006 |
|  | Number | 3 | 2 | 2 | 3 |
| T89 | Average | 139.7 | 8.56 | 27.3 | 0.268 |
|  | Max | 155.0 | 9.9 | 39.0 | 0.321 |
|  | Min | 122.0 | 7.40 | 18.6 | 0.238 |
|  | STD | 8.6 | 0.71 | 5.6 | 0.019 |
|  | Number | 40 | 39 | 36 | 42 |
|  | Upper limit | 157.1 | 10.0 | 38.7 | 0.306 |
|  | Lower limit | 122.3 | 7.1 | 15.9 | 0.229 |
| Statistics | Ratio | 1.10 | 1.01 | 1.14 | 1.02 |
|  | T-test (p-value) | 0.011 | 0.9 | 0.35 | 0.61 |
|  | Number > Upper limit | 2 | 0 | 0 | 0 |
|  | Number < Lower limit | 0 | 0 | 0 | 0 |
|  | Score | (+I) | (Normal) | (Normal) | (Normal) |

Example 7: STT543

The expression level of mRNA from the gene STT543 was analysed in different lines of the construct KR831. The reduced expression level was 7.0% to 66.2% of the wild type expression level when analysed with RT-PCR as described above.

The KR831 construct has produced transgenic trees with a significant density increase of in average 11% compared to wild type trees.

|  |  | Height (cm) | Diameter (mm) | Volume (cm3) | Density (g/cm3) |
|---|---|---|---|---|---|
| KR831 | Average | 117.4 | 7.7 | 19.1 | 0.297 |
|  | Max | 130.0 | 9.2 | 26.6 | 0.355 |
|  | Min | 100.0 | 6.2 | 9.9 | 0.265 |
|  | STD | 10.2 | 1.2 | 6.8 | 0.036 |
|  | Number | 7 | 7 | 7 | 7 |
| T89 | Average | 112.0 | 7.47 | 16.7 | 0.266 |
|  | Max | 125.0 | 8.7 | 23.4 | 0.358 |
|  | Min | 93.0 | 5.40 | 7.5 | 0.219 |
|  | STD | 8.3 | 0.77 | 4.1 | 0.022 |
|  | Number | 32 | 32 | 32 | 30 |
|  | Upper limit | 129.0 | 9.0 | 25.1 | 0.312 |
|  | Lower limit | 95.0 | 5.9 | 8.3 | 0.221 |
| Statistics | Ratio | 1.05 | 1.04 | 1.14 | 1.11 |
|  | T-test (p-value) | 0.14 | 0.47 | 0.23 | 0.0075 |
|  | Number > Upper limit | 1 | 1 | 2 | 3 |
|  | Number < Lower limit | 0 | 0 | 0 | 0 |
|  | Score | (Normal) | (Normal) | (+I) | (++) |
| Max/Avg | KR831max/WTavg | 1.16 | 1.23 | 1.59 | 1.33 |

Example 8: STT793

The expression level of mRNA from the gene STT793 was analysed in different lines of the construct KR892. The reduced expression level was 18.2% to 94.1% of the wild type expression level when analysed with RT-PCR as described above.

The KR892 construct has produced transgenic lines with height and stem volume increases of up to 17% and 55% respectively, compared to the wild type population average.

|  |  | Height (cm) | Diameter (mm) | Volume (cm3) | Density (g/cm3) Prediction from FT-IR |
|---|---|---|---|---|---|
| KR892 | Average | 158.3 | 9.1 | 34.6 | 0.315 |
|  | Max | 175.0 | 9.9 | 43.6 | 0.362 |
|  | Min | 147.0 | 7.4 | 20.8 | 0.254 |
|  | STD | 12.2 | 0.9 | 7.8 | 0.036 |
|  | Number | 7 | 7 | 7 | 7 |
| T89 | Average | 150.0 | 8.4 | 28.2 | 0.286 |
|  | Max | 173.0 | 9.6 | 47.7 | 0.328 |
|  | Min | 130.0 | 7.3 | 18.8 | 0.240 |
|  | STD | 10.6 | 0.7 | 6.0 | 0.025 |
|  | Number | 21 | 21 | 21 | 22 |
|  | Upper limit | 172.1 | 9.9 | 40.7 | 0.337 |
|  | Lower limit | 127.8 | 7.0 | 15.6 | 0.235 |
| Statistics | Ratio | 1.06 | 1.08 | 1.23 | 1.10 |
|  | T-test (p-value) | 0.09386 | 0.05448 | 0.03248 | 0.02320 |
|  | Number > Upper limit | 2 | 1 | 2 | 1 |
|  | Number < Lower limit | 0 | 0 | 0 | 0 |
|  | Score | (+I) | (Normal) | (+I) | (Normal) |
| Max/Avg | KR892max/WTavg | 1.17 | 1.18 | 1.55 | 1.27 |

Example 9: STT795

The expression level of mRNA from the gene STT795 was analysed in different lines of the construct KR894. The reduced expression level was 33.6% to 35.1% of the wild type expression level when analysed with RT-PCR as described above.

The KR894 construct has produced transgenic trees with significantly improved height, diameter and stem volume values, with height, diameter and stem volume increases of in average 7%, 8% and 24% respectively, compared to wild type trees.

|  |  | Height (cm) | Diameter (mm) | Volume (cm3) | Density (g/cm3) Prediction from FT-IR |
|---|---|---|---|---|---|
| KR894 | Average | 158.2 | 9.3 | 35.8 | 0.292 |
|  | Max | 164.0 | 9.8 | 40.8 | 0.312 |
|  | Min | 150.0 | 8.8 | 32.4 | 0.267 |
|  | STD | 5.2 | 0.4 | 3.5 | 0.018 |
|  | Number | 5 | 5 | 5 | 5 |
| T89 | Average | 148.4 | 8.6 | 28.8 | 0.291 |
|  | Max | 159.0 | 9.6 | 38.4 | 0.325 |
|  | Min | 132.0 | 7.7 | 21.1 | 0.250 |
|  | STD | 7.5 | 0.5 | 4.0 | 0.019 |
|  | Number | 31 | 31 | 31 | 31 |
|  | Upper limit | 163.8 | 9.6 | 36.9 | 0.329 |
|  | Lower limit | 133.1 | 7.6 | 20.6 | 0.252 |
| Statistics | Ratio | 1.07 | 1.08 | 1.24 | 1.01 |
|  | T-test (p-value) | 0.00867 | 0.00377 | 0.00076 | 0.84974 |
|  | Number > Upper limit | 1 | 2 | 2 | 0 |
|  | Number < Lower limit | 0 | 0 | 0 | 0 |
|  | Score | (+P) | (++) | (++) | (Normal) |
| Max/Avg | KR894max/WTavg | 1.10 | 1.14 | 1.42 | 1.07 |

Example 10: Field Trial of Hybrid Aspen with Lines Comprising a Transgene Having SEQ ID NO: 1 and Encoding a STT74 Polypeptide Hybrid aspen field trials were established to further study the improved growth properties of the transgenic trees under field conditions. Each field trial contains plants from 7 to 16 gene constructs and about 20% wild type (wt) reference plants. For each gene construct three to six transgenic plant lines, each derived from different transformational events, were selected for field trial. The transgenic plant lines were multiplied in 8 to 20 replicates each. The transgenic plant lines were distributed in field following a randomized block design. In the field all plants were separated in a 3×3 meter coordinate system to make a single cell plant design. Whenever possible the field trials were divided into two separate experimental sites, which were distant from each other and differ somewhat in environmental characteristics. The field sites were prepared and homogenized according to standard agricultural procedures such as disc harrowing and glyphosate based herbicide treatment. The hybrid aspen field trials started 2011 and is planned to proceed for 5 years. Within this time growth properties should be regularly monitored and analysed.

After two growth seasons the preliminary results show an increased height of up to 29% between transgenic plant lines and wildtype, see also Table 14.

TABLE 14

Increased growth of hybrid aspen after two growth seasons.

| Plant Lines | Mean | Ratio | LSqMean | Ratio | T-test P-value | Dunnett's P-Value |
|---|---|---|---|---|---|---|
| Height August 2012 | | | | | | |
| 35s022F3-1A | 92.0 | 0.97 | 90.6 | 0.95 | 0.7564 | 1.0000 |
| 35s022F3-1B | 111.3 | 1.18 | 111.3 | 1.17 | 0.0346 | 0.4781 |
| 35s022F3-2A | 113.5 | 1.20 | 113.5 | 1.20 | 0.0176 | 0.1956 |

TABLE 14-continued

Increased growth of hybrid aspen after two growth seasons.

| Plant Lines | Mean | Ratio | LSqMean | Ratio | T-test P-value | Dunnett's P-Value |
|---|---|---|---|---|---|---|
| 35s022F3-2B | 101.0 | 1.07 | 101.0 | 1.06 | 0.4207 | 1.0000 |
| T89-wt | 94.7 | 1.00 | 94.9 | 1.00 | * | * |
| Height September 2013 | | | | | | |
| 35s022F3-1A | 157.6 | 0.92 | 156.5 | 0.91 | 0.4227 | 1.0000 |
| 35s022F3-1B | 220.1 | 1.29 | 220.1 | 1.29 | 0.0022 | 0.0397 |
| 35s022F3-2A | 196.9 | 1.15 | 196.9 | 1.15 | 0.1156 | 0.9942 |
| 35s022F3-2B | 180.1 | 1.05 | 180.1 | 1.05 | 0.5777 | 1.0000 |
| T89 | 171.1 | 1.00 | 171.7 | 1.00 | * | * |

Example 11: Properties of the Wood of a GM Wood Plant Expressing Construct 35S022 Encoding a S1T74 Polypeptide Wood samples from three lines of GM aspen lines transformed with the 35s022 construct, expressing a polypeptide (STT74) having SEQ ID NO: 1, were analysed to determine their susceptibility to pre-treatment and enzymatic saccharification. The transgenic lines were referred to as 1A, 1B, and 2B or, alternatively, H12.1, H12.2, and H12.3. As a control, T89 hybrid aspens referred to as "wild-type" were used. Pre-treatment was performed using acid hydrolysis, a state-of-the-art method for woody biomass.

Experimental Protocol

Pre-Treatment:

Wood of wild-type and transgenic aspen lines (T89 and transgenic lines 1A, 1B, and 2B) was milled to a powder. Fifty mg of wood powder in a reaction mixture with a total weight of 1000 mg were pre-treated using a single-mode microwave system (Initiator Exp, Biotage, Uppsala, Sweden) using an acid catalyst [1% (w/w) sulphuric acid]. The pre-treatment was performed for 10 min at 165° C. The solid and liquid fractions were separated by centrifugation for 15 min at 14,100 g in pre-weighed micro-centrifuge tubes. The liquid fraction, referred to as the pre-treatment liquid, was collected for analysis, while the solid fraction was washed twice with one ml of deionized water and once with one ml of sodium citrate buffer (50 mM, pH 5.2) prior to enzymatic hydrolysis. The weight of the residual washed solids from the pre-treatment was determined.

Enzymatic Hydrolysis:

Sodium citrate buffer (50 mM, pH 5.2) and 50 mg of an enzyme cocktail consisting of equal proportions of Celluclast 1.5L and Novozyme 188 [obtained from Sigma-Aldrich (St. Louis, Mo., USA)] were added to pre-treated or non-pre-treated wood so that the total weight of the reaction mixture was 1000 mg. Reaction mixtures with wood that had not been pre-treated consisted of 50 mg of milled wood, 900 mg of the sodium citrate buffer, and 50 mg of the enzyme cocktail. The reaction mixtures were incubated for 72 h at 45° C. in an orbital shaker (Ecotron incubator shaker, Infors, Bottmingen, Switzerland) set at 170 rpm. Samples for analysis of glucose formation during the early phase of the reaction (the glucose production rate, GPR) were taken after 2 h. The liquid remaining after 72 h was analysed using high-performance anion-exchange chromatography (HPAEC).

Analysis of Hydrolysates:

The glucose concentrations during the early phase of the enzymatic reaction (the first 2 h) were measured using a glucometer. The yields of monosaccharide sugars (arabinose, galactose, glucose, xylose and mannose) in the pre-treatment liquid and in the samples taken after 72 h of enzymatic hydrolysis were determined by using HPAEC. The HPAEC system (Ion Chromatography System ICS-3000, Dionex, Sunnyvale, Calif., USA) was equipped with a PAD (pulsed amperometric detection) unit. The separation was performed using CarboPac PA20 column (3×150 mm) (Dionex) equipped with a CarboPac PA20 guard column (3×30 mm) (Dionex). Prior to injection, the samples were filtered through 0.2 μm nylon filters. A volume of 10 μl was loaded. Elution of sugars was performed with a 2 mM solution of sodium hydroxide during 27 min, followed by regeneration with 100 mM sodium hydroxide for 5 min, and equilibration with 2 mM sodium hydroxide for 15 min. The flow rate was 0.4 ml min-1. Pulsed amperometric detection of monosaccharides was performed with the detector set on Gold Standard PAD waveform and with Ag/AgCl as reference electrode. Peaks were identified and quantified by comparison of standards containing arabinose, galactose, glucose, xylose, and mannose (Sigma-Aldrich). The sugar yields in the pre-treatment liquid and in the enzymatic hydrolysates are reported as g of sugar per g of wood after pre-treatment and after 72 h of enzymatic hydrolysis, respectively.

Acetic Acid Analysis:

The concentrations of acetic acid (acetic acid in the pre-treatment liquid, and acetic acid in enzymatic hydrolysate) were determined by using the ICS-3000 system and the conductivity detector (Dionex). Separation was performed with an AS15 (4×250 mm) separation column equipped with an AG15 (4×50 mm) guard column (Dionex). The mobile phase consisted of a 35 mM solution of sodium hydroxide (Sodium Hydroxide Solution for IC, Sigma-Aldrich), and the flow rate was 1.2 ml min-1.

Carbohydrate Analysis:

One hundred mg (dry weight) of the wood powder were hydrolysed with sulphuric acid [3 ml, 72% (w/w)] for 1 h at 30° C. The reaction mixture was diluted to 2.5% sulphuric acid using deionized water and was autoclaved for 1 h at 120° C. After centrifugation (14,000 g for 20 min), the supernatant was collected and analysed with respect to monosaccharide content using the ICS-3000 system.

Results

Glucose Production Rates:

The glucose production rates (GPR), i.e. the glucose formed during the initial phase of the enzymatic reaction, is shown in FIG. 1. Without pre-treatment, the average GPR of the transgenic lines, 3.23 g L-1 h-1, was 13% higher than the GPR of the wild-type (2.87 g L-1 h-1), but the difference was not statistically significant (P<0.05). With pre-treatment, the average GPR of the three transgenic lines was 8.65 g $L^{-1}$ $h^{-1}$, while the GPR of the wild-type was only 7.45 g L-1 h-1. This 16% increase in GPR of the transgenic lines was significantly (P<0.05) higher than the GPR of the wild-type.

Yields of Monosaccharides and Acetic Acid:

Table 1 shows the yields of monosaccharides and acetic acid in enzymatic hydrolysates and in pre-treatment liquid. The table also shows the monosaccharide yields when sugars in different fractions are added together, i.e. separately, in total, and divided into pentoses (arabinose and xylose) and hexoses (galactose, glucose and mannose).

Without pre-treatment, H12.1 showed 43% higher glucose yield and 28% higher mannose yield than the wild-type (P<0.05). The line H12.3 showed 23% higher mannose yield than the wild-type (P<0.05). The average glucose yield of the transgenic lines was 28% higher than that of the wild-type (P<0.06).

The differences in yield after pre-treatment were not significant (Table 15). This can be attributed to the fact that less carbohydrate is hydrolysed in measurements of the GPR (both for non-pre-treated and pre-treated samples) and in measurements of the yield of non-pre-treated samples than in measurements of the yield of pre-treated samples.

TABLE 15

Yields of sugar and acids in enzymatic hydrolysates (after 72 h reaction) and in pretreatment liquid.

| Saccharification | Yield of Sugar/ Acetic Acid (g g$^{-1}$) | #H-H12.1 [5] | #H-H12.2 [5] | #H-H12.3 [3] | T89 | P (3 lines vs T 89) |
|---|---|---|---|---|---|---|
| Without pretreatment | $Y_{Ara/w}$ | 0.0042 ± 0.00(126) | 0.0042 ± 0.00(98.2) | 0.0033 ± 0.00(80,5) | 0.0028 ± 0.00(100) | 0.024 |
| | $Y_{Gal/w}$ | 0.0176 ± 0.00(155) | 0.0175 ± 0.00(155) | 0.0145 ± 0.00(129) | 0.0113 ± 0.00(100) | 0.16 |
| | $Y_{Glu/w}$ | 0.1962 ± 0.02(143)* | 0.1670 ± 0.06(122) | 0.1638 ± 0.02(120) | 0.1365 ± 0.01(100) | 0.053 |
| | $Y_{Xyl/w}$ | 0.0311 ± 10.00(112) | 0.0271 ± 0.00(97.8) | 0.0317 ± 0.00(114) | 0.0277 ± 0.00(100) | 0.524 |
| | $Y_{Man/w}$ | 0.0091 ± 0.00(128)* | 0.0073 ± 0.00(103) | 0.0087 ± 0.00(123)* | 0.0071 ± 0.00(100) | 0.133 |
| | $Y_{acetic\ acid}$ | 0.017 ± 0.002(101 | 0.017 ± 0.002(102) | 0.017 ± 0.001(101) | 0.017 ± 0.002(100) | 0.773 |

TABLE 15-continued

Yields of sugar and acids in enzymatic hydrolysates (after 72 h reaction) and in pretreatment liquid.

| Saccharification | | Yield of Sugar/ Acetic Acid (g g$^{-1}$) | #H-H12.1 [5] | #H-H12.2 [5] | #H-H12.3 [3] | T89 | P (3 lines vs T 89) |
|---|---|---|---|---|---|---|---|
| Acid pre-treatment | Pre-treatment liquid | $Y_{Ara/w}$ | 0.005 ± 0.002(77.2) | 0.006 ± 0.001(90) | 0.007 ± 0.003(98.2) | 0.007 ± 0.002(100) | 0.473 |
| | | $Y_{Gal/w}$ | 0.009 ± 0.004(95.7) | 0.012 ± 0.004(120) | 0.011 ± 0.002(117) | 0.010 ± 0.004(100) | 0.645 |
| | | $Y_{Glu/w}$ | 0.043 ± 0.016(80.7) | 0.044 ± 0.020(82.2) | 0.048 ± 0.023(91.1) | 0.053 ± 0.014(100) | 0.356 |
| | | $Y_{Xyl/w}$ | 0.079 ± 0.036(74.9) | 0.085 ± 0.028(80.8) | 0.103 ± 0.047(97.2) | 0.106 ± 0.030(100) | 0.300 |
| | | $Y_{Man/w}$ | 0.010 ± 0.005(82) | 0.010 ± 0.003(80.8) | 0.012 ± 0.006(99.7) | 0.012 ± 0.003(100) | 0.464 |
| | | $Y_{acetic\ acid}$ | 0.072 ± 0.021(117) | 0.080 ± 0.024(131) | 0.070 ± 0.007(114) | 0.061 ± 0.012(100) | 0.175 |
| | Enzyme hydro-lysate | $Y_{Ara/w}$ | 0.0004 ± 0.00(179) | 0.0003 ± 0.00(113) | 0.0003 ± 0.00(123) | 0.0002 ± 0.00(100) | 0.443 |
| | | $Y_{Gal/w}$ | 0.001 ± 0.00(89.6) | 0.001 ± 0.00(93.6) | 0.001 ± 0.00(88.8) | 0.001 ± 0.00(100) | 0.395 |
| | | $Y_{Glu/w}$ | 0.318 ± 0.03(106) | 0.302 ± 0.04(101) | 0.314 ± 0.03(105) | 0.298 ± 0.02(100) | 0.477 |
| | | $Y_{Xyl/w}$ | 0.005 ± 0.001(125) | 0.006 ± 0.002(154) | 0.005 ± 0.002(133) | 0.004 ± 0.001(100) | 0.151 |
| | | $Y_{Man/w}$ | 0.003 ± 0.001(90.1) | 0.003 ± 0.001(102) | 0.003 ± 0.004(106) | 0.003 ± 0.00(100) | 0.916 |
| | Pre-treatment liquid + Enzyme hydro-lysate | $Y_{Ara/w}$ | 0.005 ± 0.002(80.8) | 0.006 ± 0.001(91) | 0.007 ± 0.003(99.1) | 0.007 ± 0.002(100) | 0.515 |
| | | $Y_{Gal/w}$ | 0.010 ± 0.004(94.7) | 0.013 ± 0.004(116) | 0.012 ± 0.002(113) | 0.011 ± 0.003(100) | 0.695 |
| | | $Y_{Glu/w}$ | 0.361 ± 0.029(102) | 0.346 ± 0.049(98.4) | 0.363 ± 0.018(103) | 0.351 ± 0.020(100) | 0.798 |
| | | $Y_{Xyl/w}$ | 0.084 ± 0.036(76.8) | 0.091 ± 0.028(83.6) | 0.108 ± 0.046(98.6) | 0.109 ± 0.030(100) | 0.344 |
| | | $Y_{Man/w}$ | 0.013 ± 0.006(84) | 0.013 ± 0.003(86) | 0.016 ± 0.005(101) | 0.015 ± 0.003(100) | 0.468 |
| | Pre-treatment liquid + Enzyme hydro-lysate | $Y_{Hexoses/W}$ | 0.385 ± 0.029(101) | 0.373 ± 0.053(98.4) | 0.392 ± 0.015(103) | 0.378 ± 0.023(100) | 0.850 |
| | | $Y_{Pentoses/W}$ | 0.090 ± 0.039(77.0) | 0.098 ± 0.030(84.0) | 0.115 ± 0.050(98.6) | 0.116 ± 0.032(100) | 0.352 |
| | | $Y_{Monosaccharides/W}$ | 0.475 ± 0.054(95.6) | 0.471 ± 0.070(95.0) | 0.507 ± 0.055(102) | 0.495 ± 0.049(100) | 0.630 |

Figure 2:
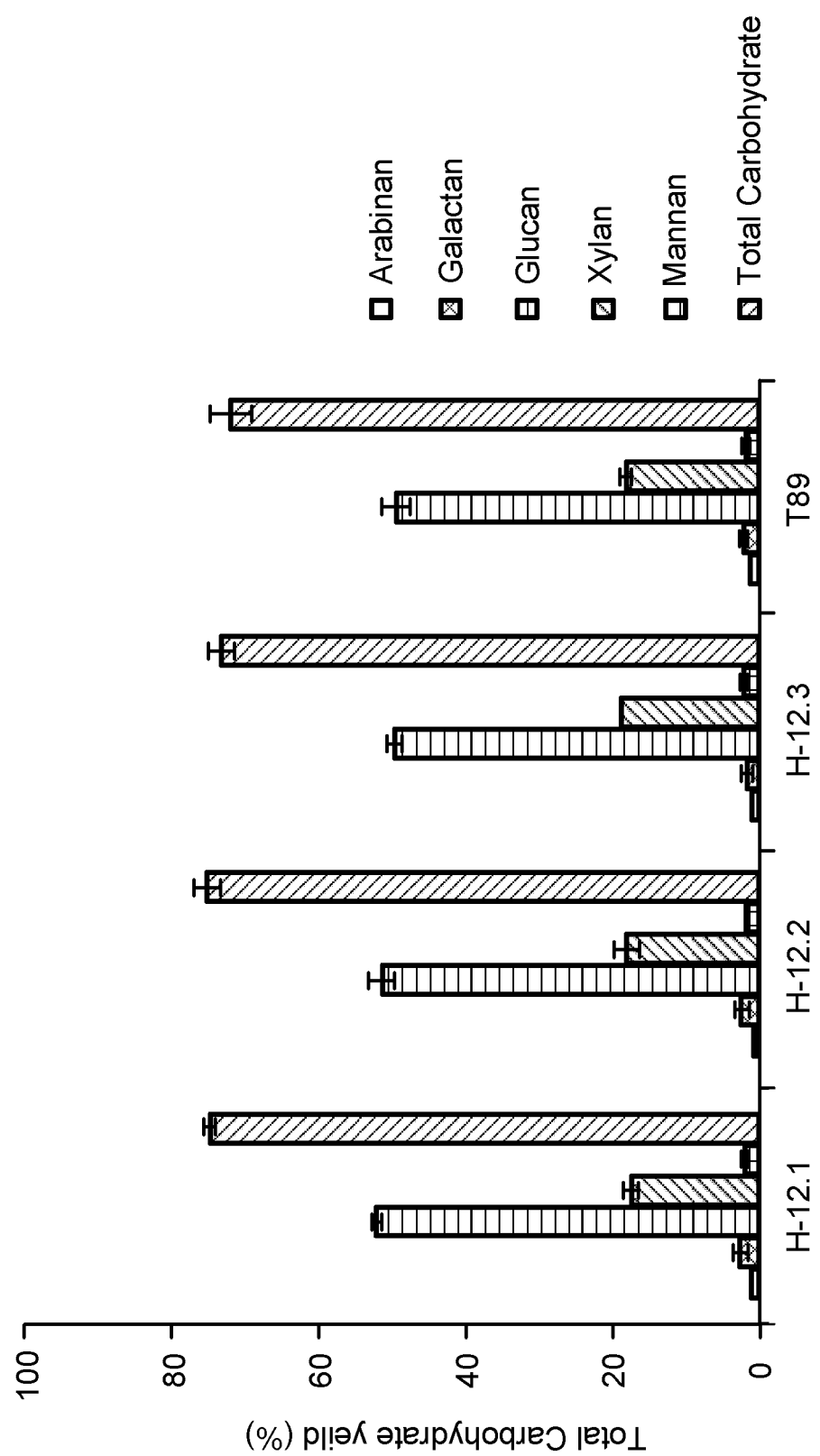
FIG. 2: Carbohydrate composition of wood samples obtained from transgenic aspen expressing construct 35S022 and wild-type aspen.

Carbohydrate Content Analysis:

FIG. 2 shows the carbohydrate contents of transgenic and wild-type hybrid aspens. The differences between the transgenic lines and the wild-type were small. This agrees with Py-GC-MS data, which also show little difference between transgenic lines and wild-type (Table 16). In conclusion, as the differences in chemical composition were small, the cellulose of the transgenic lines is significantly more susceptible to enzymatic cleavage and deconstruction of the polymeric wood structure.

TABLE 16

Py-GC/MS analysis of transgenic lines and wild-type.

| Cell wall Composition (%) | #H-H12.1 [5] | #H-H12.2 [5] | #H-H12.3 [3] | T89 |
|---|---|---|---|---|
| Carbohydrate related | 83.72 ± 1.57(101) | 82.72 ± 1.28(99.9) | 83.35 ± 1.88(100) | 82.74 ± 1.57(100) |
| Lignin | 15.21 ± 1.55(93.5) | 16.22 ± 1.26(99.8) | 15.63 ± 1.86(96.1) | 16.25 ± 1.56(100) |
| S | 8.31 ± 0.96(93.0) | 9.44 ± 0.70(105) | 8.54 ± 1.33(95.6) | 8.93 ± 1.12(100) |
| G | 5.34 ± 0.60(95.0) | 5.35 ± 0.42(95.1) | 5.30 ± 0.30(94.1) | 5.62 ± 0.51(100) |
| H | 1.30 ± 0.24(91.4) | 1.17 ± 0.24(82.0) | 1.53 ± 0.26(107) | 1.43 ± 0.30(100) |
| S/G | 1.55 ± 0.11(97.8) | 1.76 ± 0.045(110)* | 1.60 ± 0.17(101) | 1.60 ± 0.16(100) |
| P | 0.24 ± 0.01(92.2) | 0.26 ± 0.04(98.9) | 0.25 ± 0.03(97.2) | 0.26 ± 0.04(100) |

Example 12: Growth of *Arabidopsis thaliana* is Enhanced by Expression of a Transgene Encoding an STT632 Ortholog Based on phylogenetic analysis, the ortholog to STT632 (TF0137) corresponds to the gene AT2G38470 in *Arabidopsis thaliana* with the nucleic acid sequence SEQ ID No: 53. This ortholog gene, encoding the amino acid sequence SEQ ID No: 54, was cloned under the control of the 35S promoter creating the construct AtTF0137, which was over-expressed in plants.

Methods

Cloning the AT2G38470 Gene:

Based on its known sequence, the coding sequence of the *Arabidopsis thaliana* AT2G38470 gene was synthesized (Genscript), flanked by recombination sites for subsequent Gateway cloning. The synthesized gene was sub-cloned into the binary over-expression vector pK2GW7 using Gateway LR recombination cloning (Invitrogen), where the gene was placed under the control of the CaMV 35S promoter. The cloned gene was verified using restriction digestion of the final pK2GW7 vector with insert and by sequencing.

Plant Transformation:

The construct, AtTF0137, were transformed into *Arabidopsis thaliana* col-0 with the transformation method Floral dip.

Plant Growth:

The transgenic *Arabidopsis thaliana* lines of AtTF0137, were grown together with their wild-type control (col-0) plants, in a growth chamber, short days (8 h). The plants were fertilized weekly. The plants were grown for 3 weeks before harvest. During this time the diameter of the rosettes was measured once a week.

Results

The measured diameter of the rosettes of the transgenic *Arabidopsis thaliana* plants transformed with the selected gene is presented in the table below. The two lines, AtTF0137—line 2 and—line 4, showed significantly increased growth as compared to wt col-0 plants.

TABLE 17

Increased growth of *Arabidopsis thaliana*.

| Rosette diameter after 3 weeks | | | Line against col-1 |
|---|---|---|---|
| Line name | Average | Stedv | t-test |
| AtTF0137- line 1 | 5.3 | 1.1 | 0.14 |
| AtTF0137- line 2 | 7.9 | 1.6 | 0.05 |

TABLE 17-continued

Increased growth of *Arabidopsis thaliana*.

| Rosette diameter after 3 weeks | | | Line against col-1 |
|---|---|---|---|
| Line name | Average | Stedv | t-test |
| AtTF0137- line 3 | 4.4 | 0.9 | 0.03 |
| AtTF0137- line 4 | 8.6 | 1.0 | 0.01 |
| AtTF0137- line 5 | 5.2 | 0.5 | 0.01 |
| Col-1 | 6.4 | 1.1 | |

SEQUENCE LISTING (144 sequences)

SEQ ID NO: 1 - DNA, 810 bp, Populus trichocarpa
  CDS (1)..(810): Gene (STT74) encoding a vesicle-associated membrane protein
atgcctttttggcaaacaagcactggcactggcactggcaatggcaatgccacttcttcttcaactaacaccaccacttcttcttcttcaacatcttcaagttccatgagcagtaataacagtaatggcaacaatggttgtcagcagaaccaaagtaaccagcttggagaggcaagatcaagtctttattattcaacaaatgcaatgtcttttgttaccaagtctttgttgcctactagaagaagactcaggcttgatcctcctaacaagctcttcttcccttatgaaccaggaaaacaggttaggagtgccattggcataaaaaacactagcaagtctcatgtagctttcaagttccaaacaactgcaccaaagagctgttacatgcgtcctcccggggctatacttgcacctggtgaaagtcttattgcaactgtattcaagtttgtggagcctccagagaacaatgagagactactggatcagaagagcagggtaaagttcaagatcatgagcttgaaagtgaaaggagaaatggaatatgttcctgagatgtttgatgagcagaaggatcaagtagcagttgagcaaattttacgagttgtttttcttgatccagaatgccctagtcctgcactggaaaagcttaaaagacaactggctgaggctgaagctgagctcgaagcacgcaagaagcctccagaagatgcaggccccagagttgttggcgaaggacttgttatagatgagtggaaagagcggagggaaagatacctggcacgccagcaggttgaagttgattctgtgtga

SEQ ID NO: 2 - protein, 269 aa, Populus trichocarpa
MPFWQTSTGTGTGNGNATSSSTNTTTSSSSTSSSSMSSNNSNGNNGCQQNQSNQLGEARSSLYYSTNAMSFVTKSLLPTRRRLRLDPPNKLFFPYEPGKQVRSAIGIKNTSKSHVAFKFQTTAPKSCYMRPPGAILAPGESLIATVFKFVEPPENNERLLDQKSRVKFKIMSLKVKGEMEYVPEMFDEQKDQVAVEQILRVVFLDPECPSPALEKLKRQLAEAEAELEARKKPPEDAGPRVVGEGLVIDEWKERRERYLARQQVEVDSV

SEQ ID NO: 3 - DNA, 906 bp, Populus trichocarpa
  CDS (1)..(906): Gene (Potri.013G147800), encoding a VAMP-associated protein involved in inositol metabolism
aactattcaagttttccatcttttaaagcagagagtgaaagaagcctttggagtctttgcaagatgccattttggcaaacaagcaatggcaatggcaatgccgcttcttcttctactactaccacttcttcatcttcgacatcttcaagttccatgagtagtaataacagtaatggcaataatggttgtcaacagaaccaaagtaaccagcttggagagacaagatcgagtctttattattcgactaatgcaatatcgtttgttactaagtctttgttgcctactagaagaagactcaggcttgatcctcctaacaagctcttctttccttatgaaccaggtaaacaggttaggagtgcaattggcatcaagaacacttgcaagtatcatgtagctttcaagttccaaacgactgcaccaaagagctgttacatgcgtcctcccggggctatacttgctcctggagaaagtcttaccgcaactgtattcaagtttgtggaaccaccagagaacaatgatagacaaatggatcagaggagcagggttaagttcaagatcatgagcttgaaagtgaaaggagaaatggaatatgttcctgagatgtttgacgagcagaaggatcaagtagcagttgagcaaattctgcgagtaatttttcttgatccagaatgccctagccctgcactggaaaaacttaaaagacaactggctgaggctgaagctgagcttgaggcacgcaagaagcctccggaagacgcaggtccccgagtcgtcaacgaaggacttgttatagatgagtgggtaagaaagagcggagggaaagatacctggcacgccagcaggttgaagttgattctgtgtgaaagttctgtttccttttcttgcaatgttttttccttgagctga

SEQ ID NO: 4 - protein, 301 aa, Populus trichocarpa
NYSSFPSFKAESERSLWSLCKMPFWQTSNGNGNAASSSTTTTSSSSTSSSSMSSNNSNGNNGCQQNQSNQLGETRSSLYYSTNAISFVTKSLLPTRRRLRLDPPNKLFFPYEPGKQVRSAIGIKNTCKYHVAFKFQTTAPKSCYMRPPGAILAPGESLTATVFKFVEPPENNDRQMDQRSRVKFKIMSLKVKGEMEYVPEMFDEQKDQVAVEQILRVIFLDPECPSPALEKLKRQLAEAEAELEARKKPPEDAGPRVVNEGLVIDEWVRKSGGKDTWHASRLKLILCESSVSFSCNVFSLS

SEQ ID NO: 5 - DNA, 810 bp, Populus trichocarpa; identical to SEQ ID NO: 1
  CDS (1)..(810): Gene (Potri.019G116400), encoding a VAMP-associated protein involved in inositol metabolism

SEQ ID NO: 6 - protein, 269 aa, Populus trichocarpa; identical to SEQ ID NO: 2

SEQ ID NO: 7 - DNA, 795 bp, Populus trichocarpa
  CDS (1)..(795): Gene (Potri.001G408200), encoding a VAMP-associated protein involved in inositol metabolism
atggcaatatctgaccgacataaaaccaacggcgaccacagcatgaagctgtttaggctctgtcctttctggcaagcggcaactaactcttcctcttcgtcgtctacacaaaacctcaaccacagtcataacggtggcagcaacagtagccgaagcgcggcggttaatagtagcggtttgaagtcaacgacagtttcttctgttgcacgatcgcttttacccactcggcgaaggctccggcttgatccttctaataatctctacttcccttacgaacccgggaagcaagtaaaaagcgcagtaaggttaaaaaacacaagcaagtctcatgttgcttttaagtttcaaacaactgcaccgaagagctgttatatgcgtccgcccggtggtattcttgctccaggagagagccttattgcgacggttttcaagtttgtggatccaccggagaacaatgaaaaacaattggaccagaaaagcaaggctaaattcaagattgtgagtttgaaagtgaagggaggattggagtatgtgcctgaactgtttgatgaacaaaaggatcaagtaacagttgagcgagtattgcgggttgtgtttttagatgcagagcgtcctagtcctgcaatggagaaattgaagcgtcaattggctgaagcagaagctgctcttgaagtacgcaagaaacctccaccagacacaggcccccctgttgttggggaaggtcttgttattgatgaatggaaagagcggcgagaaaagtacctggctcgacaacaggttgaagcagtacagtaa

SEQ ID NO: 8 - protein, 264 aa, Populus trichocarpa
MAISDRHKTNGDHSMKLFRLCPFWQAATNSSSSSSTQNLNHSHNGGSNSSRSAAVNSSGLKSTTVSSVARSLLPTRRRLRLDPSNNLYFPYEPGKQVKSAVRLKNTSKSHVAFKFQTTAPKSCYMRPPGGILAPGESLIATVFKFVDPPENNEKQLDQKSKAKFKIVSLKVKGGLEYVPELFDEQKDQVTVERVLRVVFLDAERPSPAMEKLKRQLAEAEAALEVRKKPPPDTGPPVVGEGLVIDEWKERREKYLARQQVEAVQ

SEQ ID NO: 9 - DNA, 861 bp, Populus trichocarpa
  CDS (1)..(861): Gene (Potri.004G033500), encoding a VAMP-associated protein involved in inositol metabolism
atggccatagcggaccagagatcaccaaccgataatactcccagcaacaacaacagtaaagtgtggggattcttaaagctgccgtttttaggaggaagcaacactaatacgacaccctcttcttctactactaacactcctacttcaacgatgatgatgatgcagcagcaacagcagcagcaccaccaccaccataatcaccagcccaactccctaatcgaaggatccaatcctcctcttgcttccaattctgtctcttctgttgctagatcgctgttgccgacacgtcgtcgtcttaaactcgatccttcttccaagctttactttccttatgaacctggcaagcaggttcgcagtgccatcaggattaaaaacacttgcaagtcacatgtagcttttaagtttcaaacaactgcaccgaaaagctgtttcatgcgtcctccaggggctattcttgcacctggggaaagtatcatagctacagtcttcaagtttattgaacacccagaaattaacgagaaaccaatggagcagaagagcagggttaaatttaaaatcatgagcctgaaggtgaaaggggtcatggactatgtacctgagctgtttgatgagcagaaagatcaagtagcagtagagcaaatattgcgggttttttttctaaatccagagcgtcctggtcctgctttggaaaagttgaagcgccagttggctgatgctgatgcagctcttgaggcacgcaagaaacctccagaagatgcaggtccgaggattattggtgaaggactagtgatagatgaatggaaagagcgaagggaaagataccttgctcggcagcaggttgaaggagtagactcggtatag

SEQ ID NO: 10 - protein, 286 aa, Populus trichocarpa
MAIADQRSPTDNTPSNNNSKVWGFLKLPFLGGSNTNTTPSSSTTNTPTSTMMMMQQQQQQHHHHHNHQPNSLIEGSNPPLASNSVSSVARSLLPTRRRLKLDPSSKLYFPYEPGKQVRSAIRIKNTCKSHVAFKFQTTAPKSCFMRPPGAILAPGESIIATVFKFIEHPEINEKPMEQKSRVKFKIMSLKVKGVMDYVPELFDEQKDQVAVEQILRVFFLNPERPGPALEKLKRQLADADAALEARKKPPEDAGPRIIGEGLVIDEWKERRERYLARQQVEGVDSV

SEQ ID NO: 11 - DNA, 873 bp, Populus trichocarpa
  CDS (1)..(873): Gene (Potri.011G041900), encoding a VAMP-associated protein involved in inositol metabolism
atggtcatagcggaccagagatcacccgccgatattacgaacaacaataacaataacaataacaaagtttggggactttttaaactgccgtttttaggaggaagcgacgcgaacacgacaccctcttcttcttctactaccactgctaccactccaactatgatgatgcagcagcagcagcagcagcaccaccatcaccaccataaccaccagcacaactcgcaaattgaaggatcttctaatcctcctcacccttccaattctgtctcttctgttgctagatcgcttttgcctactcgtcgtcgtcttaaactcgatccagcttctaagctttactttccttatgaacctggcaagcaggtccggagtgccatcaggattaaaaacactagcaagtcacatgtagcgtttaagtttcaaacaactgcaccgaaaagctgtttcatgcgtcctcctggggctattcttgcacctggggaaagtatcattgctacagtcttcaagtttgttgagctgccagaaaataatgagaaaccaatggaacagaagagcaaggttaaatttaaaatcatgagcctgaaggtgaaaggggttatggactatgtacctgagctgtttgatgagcagaaagatcaggtagcaatagagcaaatattgcgggttatttttctcgatccggagcgtcctagtcctgctttggaaaagttgaagcgccaattggctgatgctgatgcagctgttgaggcacgcaagaagcctccagaagatgcaggcccaaggattatcggtgaaggactagttatagatgaatggaaagagcgaagagaaagataccttgctcggcagcagggtgaaggagtagactcagtatag

SEQ ID NO: 12 - protein, 290 aa, Populus trichocarpa
MVIADQRSPADITNNNNNNNNKVWGLFKLPFLGGSDANTTPSSSSTTTATTPTMMMQQQQQQHHHHHHNHQHNSQIEGSSNPPHPSNSVSSVARSLLPTRRRLKLDPASKLYFPYEPGKQVRSAIRIKNTSKSHVAFKFQTTAPKSCFMRPPGAILAPGESIIATVFKFVELPENNEKPMEQKSKVKFKIMSLKVKGVMDYVPELFDEQKDQVAIEQILRVIFLDPERPSPALEKLKRQLADADAAVEARKKPPEDAGPRIIGEGLVIDEWKERRERYLARQQGEGVDSV

SEQ ID NO: 13 - DNA, 795 bp, Populus trichocarpa
  CDS (1)..(795): Gene (Potri.011G126200), encoding a VAMP-associated protein involved in inositol metabolism
atgggggtgtctggccggaataaaactaacggcgaccacaacatgaagctgtttaggctctgtccgttctggcaaacagcgactaactcttccacttcctcttctacacaaaaccttaaccacagtcacaagggcagcggcaacagtgtccgacacgtggcggttaatagcagcggtttgaagtccacaacggtgtcctctgttgcgcgatcgcttttacctgctccgcgaaggctccggcttgatcctgctaataatctctacttcccttatgaacccgggaagcaagtaagaagtgcgataaggttaaaaaacagaagcaagtctcatgttgcttttaagtttcaaacaactgcaccgaagagctgttacatgcgtccacccggtggtatccttgctccaggagagagccttattgcgacggttttcaagtttgtggagcaaccggagaacaatgcaaaacaaatggaccagaagagcaatgttaaattcaagattgtgagtttgaaagtgaagggaggaatagagtatgtgcctgaactgtttgatgaacaaaaggatcaagtaacagttgagcgcatattgcgggttgtgtttttagatgcagagcatcctagtcctgcaatggagaaactgaagcttcagttggctgaagcagaggctgctcttgaagcacgcaagaaacctccaccagacacagggccccgtgttgtgggggaaggtctcgtgatagatgaatggaaagagcggcgagaaaagtacctggctcgacaacacgttgaagcagcagaatag

SEQ ID NO: 14 - protein, 264 aa, Populus trichocarpa
MGVSGRNKTNGDHNMKLFRLCPFWQTATNSSTSSSTQNLNHSHKGSGNSVRHVAVNSSGLKSTTVSSVARSLLPAPRRLRLDPANNLYFPYEPGKQVRSAIRLKNRSKSHVAFKFQTTAPKSCYMRPPGGILAPGESLIATVFKFVEQPENNAKQMDQKSNVKFKIVSLKVKGGIEYVPELFDEQKDQVTVERILRVVFLDAEHPSPAMEKLKLQLAEAEAALEARKKPPPDTGPRVVGEGLVIDEWKERREKYLARQHVEAAE

SEQ ID NO: 15 - DNA, 837 bp, Eucalyptus grandis
  CDS (1)..(837): Gene (Eucgr.F01073), encoding a VAMP-associated protein involved in inositol metabolism
atggcgatcgccgaccggcagaagccgaaggggttccgcctgtgcccgttctggcagtcgaccagcgtgaacacgtcgtcctcctcgtcctccacgcagaacctccacaccagcaatgcctaccacgaccgggacctgggccaggccgccggccgccgccccgcggacggaggatcgcgcgcgcggcccggcggcggcggcggcgtcggctcgtcgtccggcacggtgtcctcggtggccagatcgctcctccccgcccggcgccggctccggcttgatccggcgaatagcctctactttccctatgaaccggggaaacaggtgagaagcgcggtcagattgaaaaacacgagcaggtcacatgtagctttcaagttccaaaccactgcaccaaaaagctgttatatgcgtcctcctggtggtacgcttgctcctggtgaaagcattatagctacagtcttcaagtttgtggagcagccagagaataatgaaaagcaagtggaccaaaagagcaaggtgaaattcaagataatgagcctgaaagtcaaagcagggatagactatgtgcctgaactgtttgatgaacaaaaggatcaagtgacagtggagcgaattttacgtgttgtctttttagatgtcgagcgccccagtcctgcaatggaaaaactgaatcggcagttggcagaagctgaggctgctcttgaaactcgcaagaaacctccttcagtagaaacaggagctcaagttgtgggagatggtcttgtaatagatgaatggaaggagcggagggagaagtatctggctcgacaacaagtcgaagctgtaggaacagcataa

SEQ ID NO: 16 - protein, 278 aa, Eucalyptus grandis
MAIADRQKPKGFRLCPFWQSTSVNTSSSSSSTQNLHTSNAYHDRDLGQAAGRRPADGGSRARPGGGGGVGSSSGTVSSVARSLLPARRRLRLDPANSLYFPYEPGKQVRSAVRLKNTSRSHVAFKFQTTAPKSCYMRPPGGTLAPGESIIATVFKFVEQPENNEKQVDQKSKVKFKIMSLKVKAGIDYVPELFDEQKDQVTVERILRVVFLDVERPSPAMEKLNRQLAEAEAALETRKKPPSVETGAQVVGDGLVIDEWKERREKYLARQQVEAVGTA

SEQ ID NO: 17 - DNA, 810 bp, Eucalyptus grandis
  CDS (1)..(810): Gene (Eucgr.K00911), encoding a VAMP-associated protein involved in inositol metabolism
atggccctcgatcacgagagagcggagggcgaccacaagaagctgtggtcgcacctgaagatgccgttttggcagtcgaccgcgtcgtcgccgtcgcccgggacctcgtcgtcggcttctgtgccgtcgtttcagcagaaccagagcgtccaccccgatcaccaccagctcggtgatcatcactctgccagcggggtggctgcaatggcgaagtctctgcttcccgccaggcgaaggctccgtcttgatcctccgaacaagctctttttccaacatgaacctggtaagcaggttaggagtgccatcgagatcaagaacgtgtccaagactcatgtagcattcaagttccaaacaactgcccccaagagttgctacatgcggcctccagggagtgtactcgctcccggagagaatctcattgcaacagtgttcaaattcgtggagccccccgagaatgatgacaaaccagctatcttgaagagccttgttaagttcaaaatcatgagcttaaaagtaaatgggcaaatggactatgtccccgaattgtttgatgaacagagggatcaagtgacggttgagaaaattttacgggtggttttcctcgatccaaagcaaccaagtcatttgctggaaaaactaaagcggcaactggcccaagccgaagccgcactcgagacacagaagaaacctgtagaagagcccggtactggccctgtcaaggaaggagtcatagatgaatggaaggaaagaagagaaaggtacctggcacagcagcatcttgaaggtgtcgattcggttcaaatggattga

SEQ ID NO: 18 - protein, 269 aa, Eucalyptus grandis
MALDHERAEGDHKKLWSHLKMPFWQSTASSPSPGTSSSASVPSFQQNQSVHPDHHQLGDHHSASGVAAMAKSLLPARRRLRLDPPNKLFFQHEPGKQVRSAIEIKNVSKTHVAFKFQTTAPKSCYMRPPGSVLAPGENLIATVFKFVEPPENDDKPAILKSLVKFKIMSLKVNGQMDYVPELFDEQRDQVTVEKILRVVFLDPKQPSHLLEKLKRQLAQAEAALETQKKPVEEPGTGPVKEGVIDEWKERRERYLAQQHLEGVDSVQMD

SEQ ID NO: 19 - DNA, 801 bp, Eucalyptus grandis
  CDS (1)..(801): Gene (Eucgr.D00750), encoding a VAMP-associated protein involved in inositol metabolism
atggcagtggtggagcagaagccgagttccgatcagggcaaggtctggggcttcttcaagctgccgttccggagctcgggggcagcgcagaacagctcgtcgtcggcgtccgcggtctcgcacctcgggggtcaccacctccccggcgggccccaggtcgagggatcggatgggcatcacgggtcgagctcggtgtcgtccgtggcgaagtcgctgctcccgacgcggcggaggttgaagcttgatccgtccacgaagctctacttcccatatgaacctggcaagcaagttaggagtgccatcaagattaaaaacatcagcaaatcttttgtggctttcaagtttcaaacaactgcacctaaaagctgtttcatgcgtcctcctggggcaatccttgctcctggtgaaagtatcatagcaacagtgttcaagtttgtggagcatccagagaacaatgaaaaaccgatgaatcagaagagtagggtcaagttcaagattatgtgtctgaaggtgaaaggaatgatggaatatgtacctgaactgtttgatgagcagaaggatcaagtggtggtagagcgcatactgcgggttatttttctagaccccgagcgtccttgtccagctctagaaaagctgaagcgccagttggttgaagctgatgctgccgtggaggcaaaaaagaaacctccagaagatgcgggtccgaagatcattggagaagggctcgtcattgatgaatggaaggagagaagggaaagatatcttgcgcgacagcaggtggaaggggtggactcggtgtaa

SEQ ID NO: 20 - protein, 266 aa, Eucalyptus grandis
MAVVEQKPSSDQGKVWGFFKLPFRSSGAAQNSSSSASAVSHLGGHHLPGGPQVEGSDGHHGSSSVSSVAKSLLPTRRRLKLDPSTKLYFPYEPGKQVRSAIKIKNISKSFVAFKFQTTAPKSCFMRPPGAILAPGESIIATVFKFVEHPENNEKPMNQKSRVKFKIMCLKVKGMMEYVPELFDEQKDQVVVERILRVIFLDPERPCPALEKLKRQLVEADAAVEAKKKPPEDAGPKIIGEGLVIDEWKERRERYLARQQVEGVDSV

SEQ ID NO: 21 - DNA, 864 bp, Arabidopsis thaliana
  CDS (1)..(864): Gene (AT4G05060), encoding a VAMP-associated protein involved in inositol metabolism
atggctttaacggaggacaaatcagattccgatggtcgacgttggggcaaattcaaacttccatttcgaaactctaattcccaagctccttcagcctcctcgtcctcttccatggctacttcttcttcttctgtaacatcttctcatctaaatcaaaattacattcatcaatctcgccattttcaatatcacggtcctcctgtcgtcgaaggattgggtcaaaaccatcatcaatccgccgccacgatcccttctatgtcatctgtcgcgagatcgcttcttccaacaaaacgccgattaaagcttgatccttcagcaaaactttacttcccttatgagcctgggaagcaagtcaggagtgccattaagattaagaatacgagcaagtcacatgtagcgtttaagtttcaaacaacagtaccaaagagttgcttcatgcgcccggctggtgctattcttgctcccggggaagaaattatcgcaactgttttcaagtttgttgagcctcctgagaataatgaaaagccaatggaacaaaagagcggggttaagtttaaaatcatgagcttgaagatgaaagttccaacagactatatgcctgagctgtttgaggagcaaaaagatcatgtctctgaggagcaagtaatgcgtgtggtattcttggatcccgaaaaccctaactccatgatggagaaattgaagagtcaattggctgaagcggatgctgcagatgaagcacggaaaaaagcatcagagggtattgttggtccaaagccaattggagaagggcttgtgatcgatgaatggaagcaacgccgagagagatatcttgcacaacaacaaggaggagtagacgctgcttga

SEQ ID NO: 22 - protein, 287 aa, Arabidopsis thaliana
MALTEDKSDSDGRRWGKFKLPFRNSNSQAPSASSSSSMATSSSSVTSSHLNQNYIHQSRHFQYHGPPVVEGLGQNHHQSAATIPSMSSVARSLLPTKRRLKLDPSAKLYFPYEPGKQVRSAIKIKNTSKSHVAFKFQTTVPKSCFMRPAGAILAPGEEIIATVFKFVEPPENNEKPMEQKSGVKFKIMSLKMKVPTDYMPELFEEQKDHVSEEQVMRVVFLDPENPNSMMEKLKSQLAEADAADEARKKASEGIVGPKPIGEGLVIDEWKQRRERYLAQQQGGVDAA

SEQ ID NO: 23 - DNA, 945 bp, Arabidopsis thaliana
  CDS (1)..(945): Gene (AT4G21450), encoding a VAMP-associated protein involved in inositol metabolism
atgactatgacggaggagaaaccaacttccgacggcaaaggaggttggggtttcttcaagattccatttcgtaactcaagcggtcacagaaacgccgcttcaagtgctgctacttctccgtttccatctggagcttcttcttcttctacttcttctcatctacataaccatcatcaacatcatcatcaacatcaccatcagcaccatcatcagcttggttataacggtcctcacggtgatggatcgggtcaaaatcaacatccgactccttctccttcagtttcatctgttgctaagtcttttcttcctactaaacgaagattgaagcttgatccttctgagaaactctattttccttggtttgtttctgaagatttgagatccattgacactagtctaaaatttctatcttttaatgagcctgggaagcaagttaggagtgctattaagattaaaaatacaagcaaatcacatgtagccttcaagtttcaaacaactgcgccgaagagttgctttatgcgtccacctggtgctattcttgctcctggagagactattattgctactgtgtttaaatttgttgagcctcctgagaataatgagaagccaatggatcaaaggagcagagtgaagtttaaaatcatgagcctgaaggtgaaaggtccaatggactatgtgcctgagctgttcgatgagcaaaaggatgatgtctctaaggagcaaatattgcgtgtgattttcttggatcctgagcgctccaaccctgcattggaaaaactgaagcgtcaattagcagaagcggatgcagcggtggaggcacgaaagaaacctccagaggaaacaggtccaaagatgattggagaagggcttgtgatcgatgaatggaaggagcgtagagagagatatcttgcacagcaacaaggcgaaggagctgactctgtctga

SEQ ID NO: 24 - protein, 314 aa, Arabidopsis thaliana
MTMTEEKPTSDGKGGWGFFKIPFRNSSGHRNAASSAATSPFPSGASSSSTSSHLHNHHQHHHQHHHQHHHQLGYNGPHGDGSGQNQHPTPSPSVSSVAKSFLPTKRRLKLDPSEKLYFPWFVSEDLRSIDTSLKFLSFNEPGKQVRSAIKIKNTSKSHVAFKFQTTAPKSCFMRPPGAILAPGETIIATVFKFVEPPENNEKPMDQRSRVKFKIMSLKVKGPMDYVPELFDEQKDDVSKEQILRVIFLDPERSNPALEKLKRQLAEADAAVEARKKPPEETGPKMIGEGLVIDEWKERRERYLAQQQGEGADSV

SEQ ID NO: 25 - DNA, 801 bp, Arabidopsis thaliana
  CDS (1)..(801): Gene (AT5G54110), encoding a VAMP-associated protein involved in inositol metabolism
atgccaataggtgaccgtcagaatccgagtgtggagaagaagaagaacctcttcaggctatgtccgttttggcagaggagaagcaccacttcttcatcttcaacacagaatccaaaccaaaactaccgtagccgccatggaaatcggaatacagatatttccgccgtctctaagcctccgttgactatgtcttccgtcgccagatcacttcttccagctcgccgtcgtctccgactagatccttctagttatctgtatttcccttatgaacctggaaaacaagttcgcagcgcaataaagcttaagaacactagcaaatctcatactgcatttaagttccaaacaacggcacctaagagttgttatatgcgtcctcccggaggtgttttggctccaggagagagtgtttttgctactgtgttcaagtttgtggaacatccagagaacaatgaaaagcagccgttgaatcagaagagcaaggttaagtttaagattatgagcctgaaagttaaaccaggagtagagtatgtgcctgagttgtttgatgagcaaaaggatcaagtagcagtggagcaggttcttcgggtcatttttattgatgcggaccgcccaagtgctgcattggagaaactgaaacgtcaattggatgaagctgaagctgcagttgaagcaagaaagaagcctcccccagagacagggcctcgagttgtcggggagggtcttgtcatagacgaatggaaggagagaagagagaagtaccttgctcggcaacaagtcgaatccgtagattctttgtcctaa

SEQ ID NO: 26 - protein, 266 aa, Arabidopsis thaliana
MPIGDRQNPSVEKKKNLFRLCPFWQRRSTTSSSSTQNPNQNYRSRHGNRNTDISAVSKPPLTMSSVARSLLPARRRLRLDPSSYLYFPYEPGKQVRSAIKLKNTSKSHTAFKFQTTAPKSCYMRPPGGVLAPGESVFATVFKFVEHPENNEKQPLNQKSKVKFKIMSLKVKPGVEYVPELFDEQKDQVAVEQVLRVIFIDADRPSAALEKLKRQLDEAEAAVEARKKPPPETGPRVVGEGLVIDEWKERREKYLARQQVESVDSLS

SEQ ID NO: 27 - DNA, 993 bp, Populus trichocarpa
  CDS (1)..(993): Gene (STT681), encoding a GTPase activating protein
atgagccgtttgtcagagcttcagcaggttgcctcaggtaaaagaagattaaaagatctattgctccaaagtgataatcgcttttgcgctgattgtggtgctccagatccaaaatgggcatcagcaaatattggggttttcatatgcttaaaatgctgtggtgtgcacagaagtcttggtacacatatctcgaaggttttatccgtgacgttggatgaatggtctgatgatgaaattgatgccatgattgaagttggaggaaacttgtctgctaattcaatttatgaggcctttttacctgaaggagtttcaaagccagggccaaattccagtaatgaggaccgtacgaggttcatcaggtcaaagtatgagcttcaagaatttttgaaacctagtttgcggatcacatcggggaagacttcctcctcttctctcaagtcaagtttatccacaaacctttttgatagttttcaaattccgagtgtctcacagaatttggatggcatagtagagtttatgggaatattgaaggttaaagttataaaaggtacaaatttagctattagagatatgatgtcaagtgatccctatgtgatcgttgctcttgggaaacagactgctcaaaccaccgtgatgaagagcaacttgaatccagtctggaatgaagaactcatgctatctgttccacaggattttgggcccataaagttgagcgtttttgatcatgacacattttctgccgatgacataatgggggaagcagagattgacatccagccattgatcacatcagcaatggcattcggggatccagaaatgtttggaaatatgcagattggaaaatggctgaaatcaaacgacaacgccctcatagatgatagcatcataaacattgttgacgggaaggtgaaacaggagatctcattgaaactccagaatgttgaatctggggaactacaagtagaactggagtggatgcctcttgaccagtaa

SEQ ID NO: 28 - protein, 330 aa, Populus trichocarpa
MSRLSELQQVASGKRRLKDLLLQSDNRFCADCGAPDPKWASANIGVFICLKCCGVHRSLGTHISKVLSVTLDEWSDDEIDAMIEVGGNLSANSIYEAFLPEGVSKPGPNSSNEDRTRFIRSKYELQEFLKPSLRITSGKTSSSSLKSSLSTNLFDSFQIPSVSQNLDGIVEFMGILKVKVIKGTNLAIRDMMSSDPYVIVALGKQTAQTTVMKSNLNPVWNEELMLSVPQDFGPIKLSVFDHDTFSADDIMGEAEIDIQPLITSAMAFGDPEMFGNMQIGKWLKSNDNALIDDSIINIVDGKVKQEISLKLQNVESGELQVELEWMPLDQ

SEQ ID NO: 29 - DNA, 993 bp, Populus trichocarpa
  CDS (1)..(993): Gene (Potri.011G098500), encoding a Predicted Ca2+-dependent phospholipid-binding protein
atgagccgattttcagagctgaagcatgctgcctcaggtaaaagaagattaaaagatttattgctccaaagtgataatcgcttttgtgctgattgtggtgctcccgatcctaagtgggcatcagcaaatattggggttttcatatgcttaaaatgctgtggggtacacagaagccttggcacacatatctcaaaggttttatctgtgacgttggatgaatggtctgatgatgaaattgattccatgactgaagttggaggaaactcatctgctaatgcaatttatgaggcctttttacctgaaggagtttcaaagccgggaccagattccagtcatgaggagcgtatgaggttcatcaggtcaaagtatgagcttcaagagtttttgaaacctagtttgcggattacatcaggaaagacttcctcatcttctctcaagtcaagtttttccacgaagctttttgatagttttcgaattccgagtgtatcaaagaattcggaaggcatggtagaatttattggattagtgaaggttaaagttaaaaaaggtacaaatttagctatcagagatatgttgtcaagtgatccctacgtggtccttactcttgggaaacagactgttcaaaccactgtgatgaagagcaacttgaatccagtctggaatgaagaactcatgctatctgttccacaggattttgggcccataaagttgagtgtttttgatcatgacacgttttcggctgatgatataatgggggaagcagagattgacatccagccattgataacatcagcaatggcatttggggacccggaaatgtttggaaatatgcagattgggaaatggctgaaatcacatgacaatgcccttgtagttgatagcatcataaacattgttgatgggaaggtgatgcaggagatctcattgaagcttcagaatgttgagtgtggtgaactagaagtagaactagagtggatgcctcttgaccagtaa

SEQ ID NO: 30 - protein, 330 aa, Populus trichocarpa
MSRFSELKHAASGKRRLKDLLLQSDNRFCADCGAPDPKWASANIGVFICLKCCGVHRSLGTHISKVLSVTLDEWSDDEIDSMTEVGGNSSANAIYEAFLPEGVSKPGPDSSHEERMRFIRSKYELQEFLKPSLRITSGKTSSSSLKSSFSTKLFDSFRIPSVSKNSEGMVEFIGLVKVKVKKGTNLAIRDMLSSDPYVVLTLGKQTVQTTVMKSNLNPVWNEELMLSVPQDFGPIKLSVFDHDTFSADDIMGEAEIDIQPLITSAMAFGDPEMFGNMQIGKWLKSHDNALVVDSIINIVDGKVMQEISLKLQNVECGELEVELEWMPLDQ

SEQ ID NO: 31 - DNA, 996 bp, Eucalyptus grandis
  CDS (1)..(996): Gene (Eucgr.D00176), encoding a Predicted Ca2+-dependent phospholipid-binding protein
atgagtaatcgtgcgtacgaacttggcagacccgcctcaggcaagagaataataaaggatctattaaatcagagtgataaccgcttttgtgccgattgcggtgctcctgatcctaaatgggcgtcggcaaatattggagttttcatatgtttaaaatgttgtggagtgcacagaagtttgggaactcacatctcaaaggttttgtctgtaacattggatgactggtctgatgatgagattgattccatgattgaagtcggagggaattcttctgcaaatgcaatctatgaggcatttatccctgaaggagttaaaaagcctggagctgatgctagtcatgaggagcgcatgagatttatcagatctaaatatgagcttcaagaatttttgaagcctagcttacggattgcttcaaggccgtcggaaaggagcactcttcaatcaagtttttctcggaagattatggatagcttcagaagttcacattcatcaaagaattccgaaggcatggtagagtttattggtttagtgaaggtgaaagtaataaagggtacaaatttagccatcagagacatgctatcaagtgatccttatgtcgtcttgaatctcgggcagcagacagctcaaactaatgtagtcaagagcaacttgaatccagtttggaatcaggatctcatgctctctgttcctcaggattttgggcctctgaaattgcgggtatttgatcatgacacgttttcagctgatgacatcatgggagaggcagaggtagatctccaacctatgataacatctgcaatggcttttggagatgctggaatgtttggagacatgcagattggaaagtggcttaaatctcatgacaatgccctcctaatggacagcacggtcaacatagtcgatgggaaggtgaagcaggagatcttgcttaagcttcagaatgtcgaatctggagagatagagctagaattagaatggttgcccctggaccaatag

SEQ ID NO: 32 - protein, 331 aa, Eucalyptus grandis
MSNRAYELGRPASGKRIIKDLLNQSDNRFCADCGAPDPKWASANIGVFICLKCCGVHRSLGTHISKVLSVTLDDWSDDEIDSMIEVGGNSSANAIYEAFIPEGVKKPGADASHEERMRFIRSKYELQEFLKPSLRIASRPSERSTLQSSFSRKIMDSFRSSHSSKNSEGMVEFIGLVKVKVIKGTNLAIRDMLSSDPYVVLNLGQQTAQTNVVKSNLNPVWNQDLMLSVPQDFGPLKLRVFDHDTFSADDIMGEAEVDLQPMITSAMAFGDAGMFGDMQIGKWLKSHDNALLMDSTVNIVDGKVKQEILLKLQNVESGEIELELEWLPLDQ

SEQ ID NO: 33 - DNA, 1014 bp, Arabidopsis thaliana
  CDS (1)..(1014): Gene (AT4G21160), encoding a Predicted Ca2+-dependent phospholipid-binding protein
atgagttattctggagccggactcggaaagcctggctcaggtaaaaggagaataagggatcttttaactcaatctgataaccgagtctgcgctgattgtggcgctccagatcctaagtgggcgtcagctaatattggagtgtttatatgcttaaaatgttgtggtgtccacagaagccttggcagtcatatctcaaaggtcttatccgtgacattggatgaatggtcagatgaagaagtcgattcgatgattgaaattggaggaaatgcctctgcaaattcaatttacgaggcgtttattcctgaaggtagctctaagcctggacctgatgctagtcatgaccagcgtatgaggttcattaggtcgaaatatgagcaccaagagtttctgaaaccaagcttgcggatcacatccgtgaggggctctagtacaaagactccagcatttctttcatcgagtctatctaaaaagattgttgatagctttcgcactaattcatcatcgcaacagccgcaacttgaaggcatggttgagtttattggattgttgaaggtgactattaaaaagggtaccaatatggccatccgagatatgatgtcaagtgatccctatgttgtgttgactctaggacaacagaaggctcaatctactgtagtgaagagcaacttaaaccctgtctggaatgaggaactcatgctctctgttcctcataactatggctcagtgaaattgcaagtgtttgactatgacacattttctgctgatgacataatgggagaagctgagattgatatccagcctctgattacatctgcaatggcttttggagaccctgaaatgtttggagatatgcagattggaaaatggctgaaatcgcacgacaatgctcttatagaagatagcatcatcaacattgcagatggtaaagtgaagcaagaggttcaaatcaagcttcagaatgttgaatctggtgaactagaactagaaatggagtggctacctcttgagcaataa

SEQ ID NO: 34 - protein, 337 aa, Arabidopsis thaliana
MSYSGAGLGKPGSGKRRIRDLLTQSDNRVCADCGAPDPKWASANIGVFICLKCCGVHRSLGSHISKVLSVTLDEWSDEEVDSMIEIGGNASANSIYEAFIPEGSSKPGPDASHDQRMRFIRSKYEHQEFLKPSLRITSVRGSSTKTPAFLSSSLSKKIVDSFRTNSSSQQPQLEGMVEFIGLLKVTIKKGTNMAIRDMMSSDPYVVLTLGQQKAQSTVVKSNLNPVWNEELMLSVPHNYGSVKLQVFDYDTFSADDIMGEAEIDIQPLITSAMAFGDPEMFGDMQIGKWLKSHDNALIEDSIINIADGKVKQEVQIKLQNVESGELELEMEWLPLEQ

SEQ ID NO: 35 - DNA, 1011 bp, Arabidopsis thaliana
  CDS (1)..(1011): Gene (AT4G05330), encoding a Predicted Ca2+-dependent phospholipid-binding protein
atgagcaattatgcagccggactcggtaagcctggctcaggtaaaaggagaatcagagatcttttaaatcaacctgataaccgagtctgcgctgattgtggcgcttctgatcctaaatgggcatcagcaaatatcggagtattcatttgcttaaaatgttgcggtgtgcacaggagcctcggcactcatatttcaaaggttttgtctgtgacactagatgaatggtcagatgaggaagtcgattccatgattgaaattggaggaaatgcgtctgctaattcaatttatgaagcttttttacctgacacgtgctctaagcctggacctgatgttaatcatgaccagcgtatgagattcattagggcaaaatatgaactgcaagagtttctgaaaccaagcttgcggattacatccgggaaaggctcaacaaagagttcagcttttcttacatcaagtctttctagaaagatcatggatagttttcgcacaaattcatcatcgcagacgatgtttcaggaaggaatggtagagtttattggattgttgaaggtgactattaagaagggaactaacttagcaatcagagacatgatgtcaagtgatccatatgttgtgttgaatctagggaagcaaaaacttcagacaactgttatgaatagtaatttgaacccggtatggaatcaagaactcatgctgtctgttcctgagagctatggccctgtgaaattgcaagtgtatgattatgatacattttctgctgatgacataatgggagaagcagatattgatatacaacctttgataacatctgcaatggcttttggggatccagaaatgtttggggatatgcagattgggaaatggctaaaatcgcatgataacccattaatagatgacagtatcattaacattgttgatgggaaagtgaaacaggaggttcagatcaagcttcagaatgtagagtctggagaattagagctagaaatggaatggctgccacttgaccaataa

SEQ ID NO: 36 - protein, 336 aa, Arabidopsis thaliana
MSNYAAGLGKPGSGKRRIRDLLNQPDNRVCADCGASDPKWASANIGVFICLKCCGVHRSLGTHISKVLSVTLDEWSDEEVDSMIEIGGNASANSIYEAFLPDTCSKPGPDVNHDQRMRFIRAKYELQEFLKPSLRITSGKGSTKSSAFLTSSLSRKIMDSFRTNSSSQTMFQEGMVEFIGLLKVTIKKGTNLAIRDMMSSDPYVVLNLGKQKLQTTVMNSNLNPVWNQELMLSVPESYGPVKLQVYDYDTFSADDIMGEADIDIQPLITSAMAFGDPEMFGDMQIGKWLKSHDNPLIDDSIINIVDGKVKQEVQIKLQNVESGELELEMEWLPLDQ

SEQ ID NO: 37 - DNA, 1789 bp, Populus trichocarpa
  CDS (1)..(1788): Gene (STT632), encoding a transcription factor belonging to the so called WRKY family
atggctgcttcttcagggagcttagacacgtctggaaattcacacccacaaagcagtaacagctatttttctttcagcactaatagttctaatcactaccctttcatgacctcttcttctttcactgatcttcttgcttcaaatgatgaagaacccattaataataacacaggtaatagtaaattggctgataggatagctgagagaactgggtctggtgtgcctaagtttaagtctactcctcctccttctttgcctttatcccctcctcctgtttctccttcttattactttgctattcctcctggtttaagccctactgagctcttggattctccagtcatgttaaacccttctaatattttgccatctccaacaactgggacatttccaggtcagggtttgaactggaagagtagttctggtaatatccagcaaaatgtcaagaaagaagacaggagtttctctgatttctctttccagccaccagcaaggccatccacaacttcatcagccatgtttcaatcttcaaactccacagttcagcctggacagcaacaaacttggggttttcaagaacctgcaaagcaagatgagtttgtttcggggaagagtaatatggtaaaaatggaatacaattctaattcaatgaagagtttctcccctgagatcgctgcaattcaatcaaaccctcaaaacaataatgggttccaatctgatcacggtaatcaaccacaacagtatcagtctgttagggagcagaaaagatcagatgatgggtataattggaggaagtatggtcaaaaacaagttaaaggaagtgaaaatccaagaagttattacaagtgcacattccccaattgtccaacaaagaagaaagtcgagaggtccttggatggacaaattacagagatagtttacaagggtagtcataaccatcctaaacctcagtctactaggagatcatcatcaacaggatctaatcctgcaatgattccagctcctaatagtaactctaatgagattcaagatcagtcatatgttactcatggtaatggacaaatggattcatcagttgccactcctgataattcatcaatttcaattggggatgatgattttgattcacaaaagagtaaatcagtaggtggtgatgacttggatgaggatgaacctgacgccaaaagatggaaaagagagcgcgagaatgaaggaatttcagcacctggcagcagaacagtaagagaaccaagagttgtagttcaaaccaccagtgacattgatatccttgatgatgggtacaggtggaggaaatatgggcagaaggtggtcaagggaaatccaaatccaaggagctactacaagtgcacgttccaaggatgtcctgtaagaaagcatgttgagagagcatcacatgacctcagggcagtgatcactacttatgaaggaaagcacaaccatgatgttcccgctgctcgcggcagcgccagccgttcattgcaagaccacagcaacaatggcaacaacaatgcagcaatgacaattaggccatcaacagtaaaccatgtttctaacaatcccgtcaacaaccctataagaaatcaaagggcaccaccgacagcaacatccgaaggtgacatgccttttaccctagagatgctgcaaagtccaggaagttttggtttctccggatttggaaacctcatggggtcttacatgaatcaatcatcaacagatgaagttttatcaagagccaaaagagaattggaagtagagagtttttggtagg

SEQ ID NO: 38 - protein, 595 aa, Populus trichocarpa
MAASSGSLDTSGNSHPQSSNSYFSFSTNSSNHYPFMTSSSFTDLLASNDEEPINNNTGNSKLADRIAERTGSGVPKFKSTPPPSLPLSPPPVSPSYYFAIPPGLSPTELLDSPVMLNPSNILPSPTTGTFPGQGLNWKSSSGNIQQNVKKEDRSFSDFSFQPPARPSTTSSAMFQSSNSTVQPGQQQTWGFQEPAKQDEFVSGKSNMVKMEYNSNSMKSFSPEIAAIQSNPQNNNGFQSDHGNQPQQYQSVREQKRSDDGYNWRKYGQKQVKGSENPRSYYKCTFPNCPTKKKVERSLDGQITEIVYKGSHNHPKPQSTRRSSSTGSNPAMIPAPNSNSNEIQDQSYVTHGNGQMDSSVATPDNSSISIGDDDFDSQKSKSVGGDDLDEDEPDAKRWKRERENEGISAPGSRTVREPRVVVQTTSDIDILDDGYRWRKYGQKVVKGNPNPRSYYKCTFQGCPVRKHVERASHDLRAVITTYEGKHNHDVPAARGSASRSLQDHSNNGNNNAAMTIRPSTVNHVSNNPVNNPIRNQRAPPTATSEGDMPFTLEMLQSPGSFGFSGFGNLMGSYMNQSSTDEVLSRAKRELEVESFW

SEQ ID NO: 39 - DNA, 1776 bp, Populus trichocarpa
  CDS (1)..(1776): Gene (Potri.013G153400.1), encoding a Similar to SP8 binding protein homolog - cucumber. [ORG:Cucumis sativus]; [ co-ortholog (5of9) of JC6203, AAC37515,
atggctgcttcttcagggagcttagacacgtctgggaattcacacccacaaagcagtaacaactatttttctttcagcactaatagttctaatcactaccctttcatgacctcttcttctttcactgatcttcttgcttcaaatgatgaagaacccgttaataataacacaggtaatagtaagttgggtgataggatagctgagagaactggctctggcgtgcctaaatttaagtctactcctcctccttctttgcctttatcccctcctcctgtttctccttcttattactttgctattcctcctggtttaagccctactgagctcttggattctccagtcttgttaaacccttctaatattttgccatctccaacaactgggacatttccaggtcagggtttgaactggaagagtagttctggtaatatccagcaaaatgtcaagaaagaagacaggagtttctctgatttctctttccagcaaccagcaaggccatccacaacttcatctgccatgtttcaatcttcaaactccacagttcagcccggacagcaacaaacttggggttttcaagaacctgcaaagcaagatgagtttgtttcagggaagagtaatatggtaaaaatggaatacaattctaattccatgaagagtttctcccctgagatcgctgcaattcaagcaaaccctcaaagcaataatgggttccaatctgatcacggtaatcaaccacaacagtatcagtctgttagggagcagaaaagatcagatgatgggtataattggaggaagtatggtcaaaaacaagttaaaggaagtgaaaatccaagaagttattacaagtgcacattccccaattgtccaacaaagaagaaagtcgagaggtccttggatggacaaattacagagatagtttacaagggtagtcataaccatcctaaacctcagtctactaggagatcatcatcaacaggatctaatcctgcaatgattccagctcctaatagtaactctaatgagattcaagatcagtcatatgttactcatggtaatggacaaatggattcatcagttgccactcctgataattcatcaatttcaattggggatgatgattttgattcacaaaagagtaaatcagtaggtggtgatgacttggatgaggatgaacctgaggccaaaagatggaaaagagagcgcgacaatgaaggaatttcagcacctggcagcagaacagtaagagaaccaagagttgtagttcaaaccaccagtgacattgatatccttgatgatgggtacaggtggaggaaatatgggcagaaagtggtcaagggaaatccaaatccaaggagctactacaagtgcacgttccaaggatgtcctgtaagaaagcatgttgagagagcatcacatgaccttagggcagtgatcactacctatgaaggaaagcacaaccatgatgttcccgctgctcgcggcagcggcagccggtcattgcaagaccacagcaacaatggcaacaacaatgcagcaatggcaattaggccatcaacggtaaaccatgtttctaacaaccctataagaaatcaaagggcaccacctacagcaacatccgaaggtgacatgccttttaccctagagatgctgcaaagtccaggaagttttggtttctcaggatttggaaacctcatggggtcttacatgagtcaatcatcaacagatgaagttttatcaagagccaaaagagaattggaagtagagagtttttggtag

SEQ ID NO: 40 - protein, 591 aa, Populus trichocarpa
MAASSGSLDTSGNSHPQSSNNYFSFSTNSSNHYPFMTSSSFTDLLASNDEEPVNNNTGNSKLGDRIAERTGSGVPKFKSTPPPSLPLSPPPVSPSYYFAIPPGLSPTELLDSPVLLNPSNILPSPTTGTFPGQGLNWKSSSGNIQQNVKKEDRSFSDFSFQQPARPSTTSSAMFQSSNSTVQPGQQQTWGFQEPAKQDEFVSGKSNMVKMEYNSNSMKSFSPEIAAIQANPQSNNGFQSDHGNQPQQYQSVREQKRSDDGYNWRKYGQKQVKGSENPRSYYKCTFPNCPTKKKVERSLDGQITEIVYKGSHNHPKPQSTRRSSSTGSNPAMIPAPNSNSNEIQDQSYVTHGNGQMDSSVATPDNSSISIGDDDFDSQKSKSVGGDDLDEDEPEAKRWKRERDNEGISAPGSRTVREPRVVVQTTSDIDILDDGYRWRKYGQKVVKGNPNPRSYYKCTFQGCPVRKHVERASHDLRAVITTYEGKHNHDVPAARGSGSRSLQDHSNNGNNNAAMAIRPSTVNHVSNNPIRNQRAPPTATSEGDMPFTLEMLQSPGSFGFSGFGNLMGSYMSQSSTDEVLSRAKRELEVESFW

SEQ ID NO: 41 - DNA, 1641 bp, Populus trichocarpa
  CDS (1)..(1641): Gene (Potri.006G105300), encoding a DNA binding transcription factor
atggcatcttcagcttctgctagctcaactactactataaattctctatctaacctctctctcccaacccaaatcatgactttctcttctccttcttttactgatcttgtttctggtaataacaaatatatggacaacctaagctggggactttatgaatatggaactaatgatagaaatggaattgaaatcccgaacttcaagtcatttcaacctccttcactccctctatctcctcccccagtttctccttcttcttactgggccattcctcctcgtttaagcccaactgagctcttggactcacctgtacttttccctacttcctatgctcttgcatctccaacaagtgggttttttgctggtcaaaccttcaactggagaagtaattctaatgacaatcagcgaggtgttagcggagaagagaaagactgcagtgatttctctttccaaacccaaacaagacctcctacaatttcatcatcatcatcatccttgtttcaatcttcttcaaacagtgttgtagtggagaaatcactgaagaggaaacatgaagaatggaaatttaaccagtcgaagcaaactgacttttcattagatcagaaaacaggagtgaaatcagtatctgcaccagttcagagtttctcctcagaattggttccgctacaagcaaacatgcaaaacagcactgctcctcaaccaagttacaaccaatacaatcaagcaggtcattatatgagggagaatggaaggtcagaggatagatacaagtggagaaaatatggacaaaaacaagttaaaggaagtgagaatccgaggagttactataagtgcacatatccgaattgcacaacgaagaaaaaagtggagaggtctttggatggacagattactgaaatagtttataaaggaagtcacaaccattccaagcctcagtccactagaagatcatcctctcaatcagtttatccttctggaggtgccaactctgaaatctcttatcaatcaggagcaccaatggagtctggcatgatgcaggaggactcttcgatttcacttggggaggatgatattgaccatagctcaccgattagcaattctggaggagaggacaacgaaaacgaacctgatgccaaaagatggctgggacagaacgaaaatgagagtattttaggtgctggaagtaaaactgttagagaatctagaattgtggttcaaacaacaagtgacattgacatacttgatgacggctatagatggcgaaaatacgggcagaaagtcgtcaggggaaatccaaatccaaggagctactacaaatgtacatctgctggttgtcctgtgagaaaacatgtagagcgagcatcgcatgatttgagatctgtgattacaacttacgaaggaaaacacaaccatgatgttccagctgcccggggcaggggcaatgtgaacaaagctccatccaatgctaacagcactgccaatgctccgatccctataaggccttctgtcatggccagtcattctaaccagacacgttatcatccaaactcccttcacagcacaagattattgccaacatcagggagtcaagcaccatttaccctccaaatgttacagagtcaagggagttttgaatactga

SEQ ID NO: 42 - protein, 546 aa, Populus trichocarpa
MASSASASSTTTINSLSNLSLPTQIMTFSSPSFTDLVSGNNKYMDNLSWGLYEYGTNDRNGIEIPNFKSFQPPSLPLSPPPVSPSSYWAIPPRLSPTELLDSPVLFPTSYALASPTSGFFAGQTFNWRSNSNDNQRGVSGEEKDCSDFSFQTQTRPPTISSSSSSLFQSSSNSVVVEKSLKRKHEEWKFNQSKQTDFSLDQKTGVKSVSAPVQSFSSELVPLQANMQNSTAPQPSYNQYNQAGHYMRENGRSEDRYKWRKYGQKQVKGSENPRSYYKCTYPNCTTKKKVERSLDGQITEIVYKGSHNHSKPQSTRRSSSQSVYPSGGANSEISYQSGAPMESGMMQEDSSISLGEDDIDHSSPISNSGGEDNENEPDAKRWLGQNENESILGAGSKTVRESRIVVQTTSDIDILDDGYRWRKYGQKVVRGNPNPRSYYKCTSAGCPVRKHVERASHDLRSVITTYEGKHNHDVPAARGRGNVNKAPSNANSTANAPIPIRPSVMASHSNQTRYHPNSLHSTRLLPTSGSQAPFTLQMLQSQGSFEY

SEQ ID NO: 43 - DNA, 1740 bp, Populus trichocarpa
  CDS (1)..(1740): Gene (Potri.016G128300), encoding a Similar to WRKY family transcription factor; similar to member of WRKY Transcription Factor; similar to Group I; [ ortholog of At2g38470,]
atggcatcttcagcttctgcgagcatatcaaattctatgaattctccatcaaacttttctttctcgacccagtttatgacttcttcttcctctccttcttcttttactaatcttctttctagtaataacaaagacatggacaaccttagctggggactttatgaccatggaacgaatgatagaattggtattgaaatcccaaactataagtcatttcaacccttttctcctcccccagtttctccttcttcttactttgccattcctcctggtttaagcccaactgagctcttggactcacctgtgcttttccctacttctaatggtcttgcatctcctacaactggggcttttgctggtcaaaccttcaactggaggggtaattctaatgacaatcagcaaggtgttagtggagaagagaaaaactacagtgatttctctttcccaacccagacaaggcctcctgcaatttcatcatccttctttcaatcctcttcaaacagtgttacagtggagaaatccctgaaaaggaaacaagaagaatggaactttgaccaattaaagcaaactgacttttcatcagatcagaaaacaggagtaaaatcagaatttgcaccagagcagagtttctcctcggagttggtgccactccaagctaacatgcaaagtgttaacactgctgctcaaccaagtttcaaccaatacaatcaatcagctcattatatgagagagaataaaaggtctgatgatggatacaactggagaaaatatggacaaaagcaagtgaaagggagtgagaatccaaggagttattacaagtgcacatatccgaattgcccaacaaagaaaaaggtggagagatctttggatggacagattactgaaatagtttataaaggaagtcacaaccatcccaagcttcaatccagcagaagatcatcctctcaattagttcagccttctggaggtgccagctcagaaatctctgatcaatcaatcgcaccaatagagtctagcatgatgcaggaggactcttcgatttcgcttggggaggatgaatttgaccaaagttcatcaatgaattcaggagaagaggacaatgcaaatgaacccgatgccaaaagatggcagggacagaacgaaaacgagagtattttaggtgctgggagcaggactgttagagaacctagaattgtggttcaaacaacaagtgacattgacatacttgatgatggctataggtggcgaaaatatgggcagaaagtcgtcaagggaaatccgaatccaaggagctactacaaatgcacatctgttggttgtcctgtgaggaaacatgtagagcgagcatcacaggatttgagagctgtgattacaacttatgaaggaaaacacaaccatgatgttccagccgcccgcggcagcggctacatgaacaaagctccatccattgctaacagtactgccaatgcgccgatccctataaggccttccgtcatggccaatcattctaaccagacaagttatccaaactcccttcacagcacaagatcattaccagcatcaggaagtcaagcaccatttaccctcgaaatgttacagggtcaagggagttttgaatactcaagttttggaaagcagaatggcacctacatgaatcaaacacaatactccgagggtgtcttccctagagccaaggaagaaccaaagaatgactcattttttgatcccttccttaactaa

SEQ ID NO: 44 - protein, 579 aa, Populus trichocarpa
MASSASASISNSMNSPSNFSFSTQFMTSSSSPSSFTNLLSSNNKDMDNLSWGLYDHGTNDRIGIEIPNYKSFQPFSPPPVSPSSYFAIPPGLSPTELLDSPVLFPTSNGLASPTTGAFAGQTFNWRGNSNDNQQGVSGEEKNYSDFSFPTQTRPPAISSSFFQSSSNSVTVEKSLKRKQEEWNFDQLKQTDFSSDQKTGVKSEFAPEQSFSSELVPLQANMQSVNTAAQPSFNQYNQSAHYMRENKRSDDGYNWRKYGQKQVKGSENPRSYYKCTYPNCPTKKKVERSLDGQITEIVYKGSHNHPKLQSSRRSSSQLVQPSGGASSEISDQSIAPIESSMMQEDSSISLGEDEFDQSSSMNSGEEDNANEPDAKRWQGQNENESILGAGSRTVREPRIVVQTTSDIDILDDGYRWRKYGQKVVKGNPNPRSYYKCTSVGCPVRKHVERASQDLRAVITTYEGKHNHDVPAARGSGYMNKAPSIANSTANAPIPIRPSVMANHSNQTSYPNSLHSTRSLPASGSQAPFTLEMLQGQGSFEYSSFGKQNGTYMNQTQYSEGVFPRAKEEPKNDSFFDPFLN

SEQ ID NO: 45 - DNA, 1443 bp, Populus trichocarpa
  CDS (1)..(1443): Gene (Potri.019G123500), encoding a sequence-specific DNA binding transcription factor activity
atggcctcttctccagggagcttagacacttctgcaaattcacactcagaaggcagtagcaactatttttctttcaatacttacagttcttctcactaccctttcatgacttcttcttctctcactgatcttcttgcttcaagtgatgaagaacccaataatcatatcacaaataatagtaagttgtctgataggatagctgagagaactggctctggtgtgcctaagtttaagtcaattcctcctccttctttgcctttatctcctcctcctgtttctccttcttcttactttgctattcctgctggtttaagccctgcggagctcttggactctcctgtcttgttaaacccttctaatattttgccatctccaacaactggaacgtttccagctcaggcttttaattggaagagtagttatggtaatagcctgcaaaatgtcaagaaagaagacaagactttctctgatttctctttccagcaaccagcaaggccacccacaacttcaacagccatgtttcagtcttcgaacgccacaattcagcctgaacagcaacaaacatgggggtttcaagaatctgcgaagcaaggtgcgtttgtttcagggaagagtagtatggtaaaaatggaatacaactctaattctatgcagagtttctcccctgagattgctgcaattcaaacaaaccctcaaagcaacaatgggttccaatctgattatggtaatcaacaacagcagtatcaatctgttagggagcagagaagatcagaggatgggtataattggagaaagtatggtcaaaaacaagttaaaggaagtgaaaatccaaggagttattacaagtgcacataccccaattgtccaacaaaaaagatacttgagaggtctttggagggacaagtaaccgagatagtttataagggtagtcataaccatcctaaacctcagtccactaggagatcatcatcatcaacaacagcttctaatcttggaatgataccggcgcctaatagtaaccctaatgagattcaagaacagtcatatgttactcatggtagtggacaaatggactcctcagttgctacacctgagaattcttcaatttcaatcggggatgatgattttgattctcaaaggagtagatcaggaggtggtgatgactttgatgaggatgaacctgaggccaaaagatggaaaagagagggtgacaatgaagggatttcagcacctggcagcaaagcagtgagagagccaagagttgtggttcaaaccactagtgacatagacatcctagatgatgggtacaggtggaggaaatatgggcagaaagtggtcaagggaaacccaaatccaaggagctactacaagtgcacatatcaaggatgccctgtaagaaagcatgttgagagagcatcccatgaccttaccttagggcagtga

SEQ ID NO: 46 - protein, 480 aa, Populus trichocarpa
MASSPGSLDTSANSHSEGSSNYFSFNTYSSSHYPFMTSSSLTDLLASSDEEPNNHITNNSKLSDRIAERTGSGVPKFKSIPPPSLPLSPPPVSPSSYFAIPAGLSPAELLDSPVLLNPSNILPSPTTGTFPAQAFNWKSSYGNSLQNVKKEDKTFSDFSFQQPARPPTTSTAMFQSSNATIQPEQQQTWGFQESAKQGAFVSGKSSMVKMEYNSNSMQSFSPEIAAIQTNPQSNNGFQSDYGNQQQQYQSVREQRRSEDGYNWRKYGQKQVKGSENPRSYYKCTYPNCPTKKILERSLEGQVTEIVYKGSHNHPKPQSTRRSSSSTTASNLGMIPAPNSNPNEIQEQSYVTHGSGQMDSSVATPENSSISIGDDDFDSQRSRSGGGDDFDEDEPEAKRWKREGDNEGISAPGSKAVREPRVVVQTTSDIDILDDGYRWRKYGQKVVKGNPNPRSYYKCTYQGCPVRKHVERASHDLTLGQ

SEQ ID NO: 47 - DNA, 1659 bp, Eucalyptus grandis
  CDS (1)..(1659): Gene (Eucgr.B04010), encoding a  sequence-specific DNA binding transcription factor activity
atggcctcaccgtcggccggcacggggagcttggaccctcgagcgaactccttctccttctcatccctcctcgcctccgaactggaggacgactctcgccgtgggtccggggttcccaagttcaagtccatccccccgccctccatccccatctccccgctctcctctgctttcttcgccatcccgcctggtctcagccccgccgagctcttggactcccctgttctcctcaacgcttccaacattttgccctcccctactactggagctttcccgcttcaatcctccttcaattggaagagcaagtcctccgacagttaccagcagatctctaaacgggaagacgcaaatggctccgacttcactttgcagaccaacgccaagcagcatttgcagcagcagcagcagcagcagcagctggcctggagctccatcaaacaagatggttcccgccctcctgacgagagcgcggtgaaatccgaactcaatccattccagagcttctcccctgagatcgccaccatccagaccaacgccgatcaccgagccgattgcgacaattatcagtctcaggctcagtccatgcgagagcagaggagatctgacgatggctacaactggaggaaatacggccagaagcaggtgaaggggagcgaaaaccccaggagttattacaagtgcactcatcctacttgccctaccaagaagaaggtggagaggtctctggatggccagattaccgagattgtctacaagggaagccataaccaccctaagcctcaggccacccggagatcctcggcgtcctcctcctcctccgcgccgtctcatgcagtccaggtctataatcccgccgcccctgaaatcaatgaccatgctttttccacgcatggctcctcccaagtagactctgcaaccccagaaaactcttccctttcagtcgccgatgacgaatatgatcagggctctcagaaaagtaaatctgcaggggatgagttcgacgaagaccaaccggatcccaaaagatggaagcaagaggtcgagaacgaagggattttagctcccgggagcagaacggtgagagaacccagagtagtagtccaaaccaccagtgacattgatattcttgatgatggatatcgatggaggaaatatgggcagaaggtggtcaaaggaaatcccaatccaaggagctactacaagtgcaccagtccaggctgtccagtgcgcaagcacgtggagagagcatcccatgatctaagggcagtgatcactacttatgaagggaagcacaaccacgatgttcctgcagcccgcgggagtggcggcgccaataggcctttgcccatgccggacaatggcaacgggaacaatggtttggcagattcaatcaggtcgtcggccttgaccaatcattccaacaacaatgggccaagcgctccaagcagtaactatagggtgtcgtcatcggaagggcaagcatcgccgttcatgctggagatgttacagagtccggggagcttcggattttcaggacttgggagttctctgggctctttcctgaatcagtctccaaacaccgataacttgttctccagagccaaggaggaaccgagggacgacatgttcctggaatcattgctatgccgaaattattga

SEQ ID NO: 48 - protein, 552 aa, Eucalyptus grandis
MASPSAGTGSLDPRANSFSFSSLLASELEDDSRRGSGVPKFKSIPPPSIPISPLSSAFFAIPPGLSPAELLDSPVLLNASNILPSPTTGAFPLQSSFNWKSKSSDSYQQISKREDANGSDFTLQTNAKQHLQQQQQQQQLAWSSIKQDGSRPPDESAVKSELNPFQSFSPEIATIQTNADHRADCDNYQSQAQSMREQRRSDDGYNWRKYGQKQVKGSENPRSYYKCTHPTCPTKKKVERSLDGQITEIVYKGSHNHPKPQATRRSSASSSSSAPSHAVQVYNPAAPEINDHAFSTHGSSQVDSATPENSSLSVADDEYDQGSQKSKSAGDEFDEDQPDPKRWKQEVENEGILAPGSRTVREPRVVVQTTSDIDILDDGYRWRKYGQKVVKGNPNPRSYYKCTSPGCPVRKHVERASHDLRAVITTYEGKHNHDVPAARGSGGANRPLPMPDNGNGNNGLADSIRSSALTNHSNNNGPSAPSSNYRVSSSEGQASPFMLEMLQSPGSFGFSGLGSSLGSFLNQSPNTDNLFSRAKEEPRDDMFLESLLCRNY

SEQ ID NO: 49 - DNA, 1683 bp, Eucalyptus grandis
  CDS (1)..(1683): Gene (Eucgr.K02940), encoding a DNA binding transcription factor
atgaaatcttcgttcaccgatctgttgaacggcagcatgggcatggacaataaccactgggcgttctccgggacggccccgacggccaacgtctcgatggaggcccccaagtacaggtccaccgcgcctccttccctgcccctctcgcctcctccgatctcgccttctggcttcttgaccttcccgcccggcttgagccccagcgatttcctcgactcgccgctcctcttctcgtcttccaatgttgagtccccgaccgtgggagcttttgctggggaagctgccagctggaggagcggcggcggcggcttcggcggtgctttcaagggggaggagaagttgttctctgacttctctttccaaccccaccaatcacgccccaccgctgccgccaccgcggcgccatcctccatgcctcagtcatcttcggccatggtttctgtggaggtgtcgtcaaagactcaagactcatggaattactataaacccttgatgcagacggatgtgttgccagagaagagaggacgtgaaacgtcggagtttgcccggatccagaactcggcaattcccgcgagccaaacaagcacacaaagcctaacaccaccttctgaaacactcccggccaacgcgaatactaatcctcatccatcctacctcatcagagaacagaagaaatccgacgatgggtacaattggaggaagtacggtcagaagcaagtgaaagggagcgagaacccgcgcagctactacaagtgcacacacccagcttgcccaacgaagaagaaggtcgagagatccttggagggacacattaccgagattgtgtacaagggaactcacaaccacgccaagccactgtccaccaggagatcgtcttcccagtcgattcagcctcagtcttcttccactgcatatttggagaatcccgatcgattggctatggtcctgtccgaaaacgggcagcaggactcttcggcctcaatgggggatgaggatttcgaagagaactctcagatgagcaactctgcaggcgatgacgatggaagcgaacctgaagcgaagcgattgagaggagagaatgaatacgagagctatgcagcttctggcaataggactgtgagagagcctagagttgtggttcagacgatgagtgagattgatattctcgatgatggatatagatggagaaagtatggacagaaagtggtgaaaggaaaccacaatccaaggagctactataaatgtacatacgccggatgccccgtgcggaagcacgtcgagcgggcatctaacgatatgcgggccgtgatcacgacttacgaaggcaagcacaaccatgatgtccccgcaccacgtggcagcagcactcaatacgtgaaccggcctcagccttctaacaacagcagcagcatcgcgccgatgccaatcaggccctccactgtggcgggccactctaacaactcgacctacctaagttccatagagaatacgaggtttcaacgatcagggaaccacgcgcccttcactctgcaaatgttgcagagttcagatagttacggagccgtgggatcagggaagcaagggggatcgtacatgaatcaaaccccaaactgggatgacatgttcgcgaggactaaggaagagccaagagacggctcggagttcgactcgtttctaaactga

SEQ ID NO: 50 - protein, 560 aa, Eucalyptus grandis
MKSSFTDLLNGSMGMDNNHWAFSGTAPTANVSMEAPKYRSTAPPSLPLSPPPISPSGFLTFPPGLSPSDFLDSPLLFSSSNVESPTVGAFAGEAASWRSGGGGFGGAFKGEEKLFSDFSFQPHQSRPTAAATAAPSSMPQSSSAMVSVEVSSKTQDSWNYYKPLMQTDVLPEKRGRETSEFARIQNSAIPASQTSTQSLTPPSETLPANANTNPHPSYLIREQKKSDDGYNWRKYGQKQVKGSENPRSYYKCTHPACPTKKKVERSLEGHITEIVYKGTHNHAKPLSTRRSSSQSIQPQSSSTAYLENPDRLAMVLSENGQQDSSASMGDEDFEENSQMSNSAGDDDGSEPEAKRLRGENEYESYAASGNRTVREPRVVVQTMSEIDILDDGYRWRKYGQKVVKGNHNPRSYYKCTYAGCPVRKHVERASNDMRAVITTYEGKHNHDVPAPRGSSTQYVNRPQPSNNSSSIAPMPIRPSTVAGHSNNSTYLSSIENTRFQRSGNHAPFTLQMLQSSDSYGAVGSGKQGGSYMNQTPNWDDMFARTKEEPRDGSEFDSFLN

SEQ ID NO: 51 - DNA, 1182 bp, Arabidopsis thaliana
  CDS (1)..(1182): Gene (AT2G30250), encoding a WRKY transcription factor 25 sequence-specific DNA binding transcription factor activity
atgtcttccacttctttcaccgaccttcttggttcttccggcgttgactgttacgaagatgatgaagacttgagagtttctgggtcgagttttggtgggtactatccagagagaaccgggtctggtttacctaagttcaagacggctcaaccaccacctcttccgatttcacaatcttctcataacttcactttctccgattaccttgattctcctctgcttctcagctcctcacacagtttgatatctccaacaacaggaacgtttccattgcaaggctttaatggaacaacaaacaatcactcagattttccctggcagctacaatctcaaccatcaaacgcttcttctgctttgcaagaaacatatggtgttcaagatcacgagaagaagcaggagatgattcctaatgagattgcaacacaaaacaacaatcaaagttttggaacagaacgtcagataaagataccagcatacatggtgagtaggaactctaatgatggttatggttggagaaaatacggtcagaaacaagtgaagaagagcgaaaaccctaggagttacttcaagtgtacgtatcctgattgtgtttccaagaagattgttgagacggcttctgatggacagatcactgagatcatttataaaggtggtcataatcatcctaagcctgagttcaccaagagaccatctcaatcttcattaccatcatcggttaatgggaggcgcttgtttaatcctgcttctgttgttagtgaacctcatgatcaatcagagaactcttcgatttcgtttgactatagtgatcttgagcagaaaagttttaaatcagagtatggtgagatagatgaagaggaggaacaacctgagatgaagaggatgaaaagagaaggtgaagatgaagggatgtctatagaagtaagcaaaggagttaaagagccaagagttgtggttcagacaataagtgatattgatgttcttatagatggctttagatggaggaaatatggtcaaaaagttgtcaaaggaaatactaatccaaggagctactacaagtgcacattccaaggttgtggagtgaagaagcaagtggaaagatccgcagcagacgagagagcagttctcactacctatgaaggaagacacaatcacgatatcccaaccgcgctacgtcgctcgtga

SEQ ID NO: 52 - protein, 393 aa, Arabidopsis thaliana
MSSTSFTDLLGSSGVDCYEDDEDLRVSGSSFGGYYPERTGSGLPKFKTAQPPPLPISQSSHNFTFSDYLDSPLLLSSSHSLISPTTGTFPLQGFNGTTNNHSDFPWQLQSQPSNASSALQETYGVQDHEKKQEMIPNEIATQNNNQSFGTERQIKIPAYMVSRNSNDGYGWRKYGQKQVKKSENPRSYFKCTYPDCVSKKIVETASDGQITEIIYKGGHNHPKPEFTKRPSQSSLPSSVNGRRLFNPASVVSEPHDQSENSSISFDYSDLEQKSFKSEYGEIDEEEEQPEMKRMKREGEDEGMSIEVSKGVKEPRVVVQTISDIDVLIDGFRWRKYGQKVVKGNTNPRSYYKCTFQGCGVKKQVERSAADERAVLTTYEGRHNHDIPTALRRS

SEQ ID NO: 53 - DNA, 1560 bp, Arabidopsis thaliana
  CDS (1)..(1560): Gene (AT2G38470), encoding a WRKY transcription factor 33 response to salt stress
atggctgcttcttttcttacaatggacaatagcagaaccagacaaaacatgaatggttctgctaattggtcacaacaatccggaagaacatctacttcctctttggaagatcttgagataccaaagttcagatcttttgctccttcttcaatctctatctctccttctcttgtctctccttccacttgtttcagtccctctctttttctcgattcccctgcttttgtctcctcctctgctaacgttctagcttctccaaccacaggagctttaatcacaaacgtaactaaccagaaaggtataaatgaaggagacaagagcaacaacaacaactttaacttattcgatttctcattccacacacaatcatcaggagtttctgctccgaccacaactacaactacaactacaactacaacaacaacaaacagttctatctttcaatctcaggaacaacagaagaagaaccagtcagaacaatggagccaaaccgagactcgtccaaacaatcaagctgtatcttacaatggaagagagcaaaggaaaggagaggatggttacaattggagaaagtacggacaaaaacaggtgaaaggaagtgagaatcctcggagttactataagtgtactttccctaattgtccaacgaagaagaaagtggagagatctttggaaggtcagatcacagagattgtgtataaaggaagccacaaccatcctaaacctcagtctactagaagatcttcttcgtcttcttcgacttttcattcagctgtgtacaatgccagtttggatcataatcgtcaagcttcttctgatcagcctaattccaataatagctttcatcagtctgattcctttgggatgcaacaagaggataatactacttctgattctgttggtgacgatgagttcgaacaaggctcatcgattgtcagcagagacgaagaagattgtgggagtgaacctgaagcaaagagatggaaaggggacaatgaaacaaatggtgggaatggtggtggaagcaagacagtgagagagccgagaatcgtagtgcagacaacgagtgatattgacattcttgacgacggttacagatggagaaaatacggccagaaagtcgttaagggaaacccaaatccaagaagctactacaagtgcacaaccatcggttgtccagtgaggaaacatgtggagagagcatcacacgacatgagagcagtaatcacaacctacgaagggaaacacaaccacgatgttcctgcagctcgtggtagcggttacgccacaaacagagcaccacaggattcgtcttcagtcccgattagaccagctgctattgctggtcactccaactacactacttcttctcaagcaccatatacacttcagatgctgcacaacaacaacactaataccgggccttttggttacgccatgaacaacaataacaacaacagcaaccttcaaacgcaacaaaactttgttggtggtggattctctagagcaaaggaagaaccaaacgaggagacctcatttttcgattcgtttatgccctga

SEQ ID NO: 54 - protein, 519 aa, Arabidopsis thaliana
MAASFLTMDNSRTRQNMNGSANWSQQSGRTSTSSLEDLEIPKFRSFAPSSISISPSLVSPSTCFSPSLFLDSPAFVSSSANVLASPTTGALITNVTNQKGINEGDKSNNNNFNLFDFSFHTQSSGVSAPTTTTTTTTTTTTTNSSIFQSQEQQKKNQSEQWSQTETRPNNQAVSYNGREQRKGEDGYNWRKYGQKQVKGSENPRSYYKCTFPNCPTKKKVERSLEGQITEIVYKGSHNHPKPQSTRRSSSSSSTFHSAVYNASLDHNRQASSDQPNSNNSFHQSDSFGMQQEDNTTSDSVGDDEFEQGSSIVSRDEEDCGSEPEAKRWKGDNETNGGNGGGSKTVREPRIVVQTTSDIDILDDGYRWRKYGQKVVKGNPNPRSYYKCTTIGCPVRKHVERASHDMRAVITTYEGKHNHDVPAARGSGYATNRAPQDSSSVPIRPAAIAGHSNYTTSSQAPYTLQMLHNNNTNTGPFGYAMNNNNNNSNLQTQQNFVGGGFSRAKEEPNEETSFFDSFMP

SEQ ID NO: 55 - DNA, 930 bp, Arabidopsis thaliana
  CDS (1)..(930): Gene (AT5G07100), encoding a WRKY DNA-binding protein 26 sequence-specific DNA binding transcription factor activity
atgggctcttttgatcgccaaagagctgttccgaaattcaaaacagcaacaccgtcaccgctccctctttctccttcgccttacttcactatgcctcctggccttactcccgccgactttctcgactctcctcttctcttcacttcctccaacattttgccgtctcctacgacaggcacatttccagcgcaatctctgaactataacaataacggtttgctcattgacaaaaatgaaatcaaatatgaagacacaactcctcccttgttcctaccatctatggtaactcagcctttacctcaactggatttattcaaatccgaaatcatgtcgagtaacaaaacctctgatgacggctacaattggcgcaaatacgggcagaagcaagtcaaaggaagcgaaaacccgaggagttacttcaaatgcacgtatccaaattgtctcacaaagaagaaagtagagacgtctcttgtgaagggtcagatgattgagattgtctataaaggaagccacaatcatcccaagccccaatccacgaagcgatcatcttccaccgctatagcagcacatcagaacagcagtaatggagacggtaaagacattggtgaagatgaaacagaggccaagagatggaaaagagaagagaatgtgaaggagccaagagtggtggttcagacaacaagtgatatagacattcttgacgatggctacagatggagaaagtatggtcagaaagtcgtcaagggtaatccaaatccaaggagctattacaagtgcacatttacaggatgttttgtaaggaaacacgttgaaagagcatttcaagatcccaagtcagtgatcacaacttacgaaggaaaacacaaacaccaaatcccgaccccaagaagaggtccagttttaaggttacttggaaaaacagagacataa

SEQ ID NO: 56 - protein, 309 aa, Arabidopsis thaliana
MGSFDRQRAVPKFKTATPSPLPLSPSPYFTMPPGLTPADFLDSPLLFTSSNILPSPTTGTFPAQSLNYNNNGLLIDKNEIKYEDTTPPLFLPSMVTQPLPQLDLFKSEIMSSNKTSDDGYNWRKYGQKQVKGSENPRSYFKCTYPNCLTKKKVETSLVKGQMIEIVYKGSHNHPKPQSTKRSSSTAIAAHQNSSNGDGKDIGEDETEAKRWKREENVKEPRVVVQTTSDIDILDDGYRWRKYGQKVVKGNPNPRSYYKCTFTGCFVRKHVERAFQDPKSVITTYEGKHKHQIPTPRRGPVLRLLGKTET

SEQ ID NO: 57 - DNA, 468 bp, Populus trichocarpa
  CDS (1)..(468): Gene (STT153), encoding a zinc finger protein
atgagcagaccaggagattggaattgcaggtcatgccaacacttgaacttccagaggagggactcgtgccagcgttgtggggacccaaggcccggagagagagatcattatggaagttttggtggaagatcagggggctcgttcggatttacggggcctgatgttaggcctggtgactggtattgctcggttggcaactgtggagctcacaactttgctagtcgttcaagctgcttcaagtgtggtatgtccaaggatgaatcctctggtggtgggcttgatgctgacatttcgtggatgagaggttatggcttcggcggaggcagcgcctctagccgctctaattggaaatccggagactggatttgcaccaggtcaggttgcaacgagcacaactttgctagcagaactgagtgttacagatgcaatgcaccaagagaatcaggcagcaacaagtcttcgtattaa

SEQ ID NO: 58 - protein, 155 aa, Populus trichocarpa
MSRPGDWNCRSCQHLNFQRRDSCQRCGDPRPGERDHYGSFGGRSGGSFGFTGPDVRPGDWYCSVGNCGAHNFASRSSCFKCGMSKDESSGGGLDADISWMRGYGFGGGSASSRSNWKSGDWICTRSGCNEHNFASRTECYRCNAPRESGSNKSSY

SEQ ID NO: 59 - DNA, 480 bp, Populus trichocarpa
  CDS (1)..(480): Gene (Potri.006G251300), encoding a zinc finger (Ran-binding) family protein; [ co-ortholog (1of2) of At5g25490]
atgagcagaccaggagattggaattgcaggtcatgccagcacttgaactttcaaaggagggactcatgccagcgttgcggtgatccaaggcccggagagagagatcactatggaagtttcggtggaagatcatcagggggctcattcggatttacgggccctgatgttaggcctggtgattggtattgcacggctggcaattgtggagctcacaactttgctagtcgttcaagctgcttcaagtgtggtgtgtccaaggatgaatcctctggtggtggacttgatgctgacatgtcacggatgagaggttatggcttcggcggaggcggaggcggaggcagtggctctagccgtaattggaaatccggagactggatttgcaccaggtccggttgcaacgagcacaactttgctagcaggactgaatgctatagatgcaatgcaccaagagaatctagcagcaacaagtcttcgtattaa

SEQ ID NO: 60 - protein, 159 aa, Populus trichocarpa
MSRPGDWNCRSCQHLNFQRRDSCQRCGDPRPGERDHYGSFGGRSSGGSFGFTGPDVRPGDWYCTAGNCGAHNFASRSSCFKCGVSKDESSGGGLDADMSRMRGYGFGGGGGGGSGSSRNWKSGDWICTRSGCNEHNFASRTECYRCNAPRESSSNKSSY

SEQ ID NO: 61 - DNA, 456 bp, Populus trichocarpa
  CDS (1)..(456): Gene (Potri.001G172700), encoding a zinc finger (Ran-binding) family protein; [ co-ortholog (1of2) of At3g15680]
atgaacaggccaggagactggaactgcaggtcatgccaacacctcaatttccagaggcgtgactcttgccaacgttgtggggaccccaggtccgcaggtgattttgggggtttcggtgggcggggtggctcatcacttgggttcaccgggtcggatgttcgtcccggtgattggtactgcactgccggaaactgcggggcccacaactttgctagccgttctagttgcttcaaatgtggagtgtacaaggaaatggactccgccgggggcttcgattctgatttttctcgaactagagggtttggtgggagcactggaggtggcaatcgatctggatggaaatccggagactggatttgcactaggtggggatgcaacgaacataactttgctagcagaatggagtgcttcaagtgcaatgccccaagagatcttagcaacagaacttcatactag

SEQ ID NO: 62 - protein, 151 aa, Populus trichocarpa
MNRPGDWNCRSCQHLNFQRRDSCQRCGDPRSAGDFGGFGGRGGSSLGFTGSDVRPGDWYCTAGNCGAHNFASRSSCFKCGVYKEMDSAGGFDSDFSRTRGFGGSTGGGNRSGWKSGDWICTRWGCNEHNFASRMECFKCNAPRDLSNRTSY

SEQ ID NO: 63 - DNA, 489 bp, Eucalyptus grandis
  CDS (1)..(489): Gene (Eucgr.F02548), encoding a Zn-finger in Ran binding protein and others, zinc ion binding
acacgctttgccttgttaagttcattgctagcggcaaagatgagtaggcccggagactggaactgcaaatcgtgccagcacctcaacttccagaggcgcgactcgtgccaacgctgcggggatgcaaagtgcagtggcgactttgcaagttttggcggaaggagtggatcctcgttcgggttcactggctccgatgtccgtcctggagattggtattgcaccgttggaaactgcgggactcataactttgccagccgctcgacctgcttcaaatgcggtgcattcaaggaagacttggccggtggctatgattttgacgcgccgcgctctagaggtgtaggcaacagcgctggtggaagccgatccggatggaaatcgggcgattggatctgcaataggtttggctgcaatgaacacaacttcgccagcagaatggaatgcttccggtgcaatgcccctcgggactactctagcaaccgatcttactag

SEQ ID NO: 64 - protein, 162 aa, Eucalyptus grandis
TRFALLSSLLAAKMSRPGDWNCKSCQHLNFQRRDSCQRCGDAKCSGDFASFGGRSGSSFGFTGSDVRPGDWYCTVGNCGTHNFASRSTCFKCGAFKEDLAGGYDFDAPRSRGVGNSAGGSRSGWKSGDWICNRFGCNEHNFASRMECFRCNAPRDYSSNRSY

SEQ ID NO: 65 - DNA, 507 bp, Eucalyptus grandis
  CDS (1)..(507): Gene (Eucgr.C02807), encoding a Zn-finger in Ran binding protein and others, zinc ion binding
atgagcaggccgggagactggaactgcaggtcgtgccagcacctcaacttccagaggcgagagtcgtgccagaggtgcggggagccgagggccagcgagaggggtggcgattcctatgggggcttcggcgggaggagcggctcgccattcaggttcacaggcccggacgtccggcctggcgactggtactgcagcgtcgacaactgtgggaatcacaacttcgccagccgctcgacctgcttcaggtgtggtgcgccgagagacgagtcggacggcggcggcggtggcgggggccatcgttatgagggtgaaatgtctcggccgcgaggttttggagccagcggcagcagtggaggtggcagcagtcgctcggggtggagagctggtgactggatttgcaccaggtcaggatgcaatgagcataactttgctagcagatcaaactgcttcaggtgcaatgcgccaagagattattcatctggtggccggtctgattattcttcttga

SEQ ID NO: 66 - protein, 168 aa, Eucalyptus grandis
MSRPGDWNCRSCQHLNFQRRESCQRCGEPRASERGGDSYGGFGGRSGSPFRFTGPDVRPGDWYCSVDNCGNHNFASRSTCFRCGAPRDESDGGGGGGGHRYEGEMSRPRGFGASGSSGGGSSRSGWRAGDWICTRSGCNEHNFASRSNCFRCNAPRDYSSGGRSDYSS

SEQ ID NO: 67 - DNA, 462 bp, Eucalyptus grandis
  CDS (1)..(462): Gene (Eucgr.C01779), encoding a Zn-finger in Ran binding protein and others, zinc ion binding
atgagtaggcctggagattggaactgccggtcgtgccaccacctgaacttccaaaggcgagagtcgtgccagagatgcggagagccacgccccagcagtttaggtggaggaaggagcaactcgtctttcaggtccggcaccgccatggatgtgaggcttggtgattggtattgcggtgttgggggctgtggaacgcacaattttgccagccgctcgagctgcttcaggtgtggctcggcaaaggatgaaacaccaaccgttggtgggtatgacggcgacatgactcggatgcgaggtttcgggtacagcagtggcactagcgcgaaccggtcggggtggaagcctggcgattggatatgtggaaggtcggggtgcaaggagcacaactttgcaagcaggacagaatgtttcaggtgcaatgccccaagagaatctggtggtgtgtcttcctcttcttcgtaa

SEQ ID NO: 68 - protein, 153 aa, Eucalyptus grandis
MSRPGDWNCRSCHHLNFQRRESCQRCGEPRPSSLGGGRSNSSFRSGTAMDVRLGDWYCGVGGCGTHNFASRSSCFRCGSAKDETPTVGGYDGDMTRMRGFGYSSGTSANRSGWKPGDWICGRSGCKEHNFASRTECFRCNAPRESGGVSSSSS

SEQ ID NO: 69 - DNA, 513 bp, Arabidopsis thaliana
  CDS (1)..(513): Gene (AT5G25490), encoding a Zn-finger in Ran binding protein and others, zinc ion binding
atgaataggccgggagattggaactgcagattgtgtagccacctcaacttccagaggagggattcatgccaacgttgtagagagcctagaccgggcgggatcagtaccgatttactcagcggttttggtggccgtccggttagtagctccttcggtttcaacaccgggcccgatgtgcgacccggggattggtattgcaaccttggggattgtgggacacataattttgccaataggtccagttgtttcaagtgtggtgccgcaaaagatgagttttcatgctcaagtgctgctgcaacaaccgggtttatggacatgaatgttggtccgagacgtggcctttttggttttggcggcagcagtagtggtggtggtggtacgggccgttctccttggaaatctggagattggatttgcccaaggtcaggctgtaacgaacataacttcgcaagcaggtcagagtgtttcaggtgtaacgcaccaaaggaacttgccaccgaaccaccctattag

SEQ ID NO: 70 - protein, 170 aa, Arabidopsis thaliana
MNRPGDWNCRLCSHLNFQRRDSCQRCREPRPGGISTDLLSGFGGRPVSSSFGFNTGPDVRPGDWYCNLGDCGTHNFANRSSCFKCGAAKDEFSCSSAAATTGFMDMNVGPRRGLFGFGGSSSGGGGTGRSPWKSGDWICPRSGCNEHNFASRSECFRCNAPKELATEPPY

SEQ ID NO: 71 - DNA, 495 bp, Arabidopsis thaliana
  CDS (1)..(495): Gene (AT3G15680), encoding a Ran BP2/NZF zinc finger-like superfamily protein
atgagcagacccggagattggaactgcaggtcatgcagccatctcaacttccagcgccgtgactcttgccagcgatgcggtgactctcgttccggccccggtggagttggtggcttagactttggtaatttcggtggcagagccatgtctgctttcggattcaccaccggctccgacgttcgtcccggtgattggtactgcaccgtgggaaactgcgggacacacaacttcgccagtcgctccacctgcttcaaatgcggcactttcaaggacgagaccggcgctggaggcggaggtggtggcatcggcggtccggccatgtttgacgccgacattatgcggtctagagtccccggtaacggtggtcgctctagctggaaatccggcgactggatttgcactaggattggttgcaatgagcataactttgcaagcagaatggaatgcttcaggtgcaatgcaccaagggacttcagcaacagaacctctttctaa

SEQ ID NO: 72 - protein, 164 aa, Arabidopsis thaliana
MSRPGDWNCRSCSHLNFQRRDSCQRCGDSRSGPGGVGGLDFGNFGGRAMSAFGFTTGSDVRPGDWYCTVGNCGTHNFASRSTCFKCGTFKDETGAGGGGGGIGGPAMFDADIMRSRVPGNGGRSSWKSGDWICTRIGCNEHNFASRMECFRCNAPRDFSNRTSF

SEQ ID NO: 73 - DNA, 1587 bp, Populus trichocarpa
  CDS (1)..(1587): Gene (STT258), encoding a calmodulin binding protein
atgggaaagaaagggagttggttttcagcaatcaagagggtctttctaccaaactccaaggacaaactagctaatgaatcagataagagaagcgcaaaagaaaagaagaagaagggtcgtggaaaactaagacatggagagaccacttcattcattcccctgtttagagaaccaagtagtatcgagaaaattttggatgaggctgaaagagagcataaattaattttcaggcctcccacacctcctgagcaaccgactacaccaccctttgtgcctccaagatctgcttctccgagggttgcttctcaaagagtcacctctccaagagctgcttcccctagagctgcatctccaagggttgcttctcctagagcagcttctcctaggaatgctcaacgccataaggagatatattacagaccagaaccaactctaagaaaccatcatgcttcagcaaccaagatccaagcagcctatagaggctatgttgcaaggaggagcttcagagctttgaagggtcttgtgaggcttcaaggagtgataagaggacagaatgtgaagcggcagacgatgaatgcaatgaaatacatgcagctcttggttcgggtccagtctcagattcagtcacggaggatccaaatgttagaaaaccaagcacgacgtcaagctcaaaacaaaaatgataaagaagtggatggtaccttgggcaaatggggccagtcgcctgaggcaggtaatagtgaagactgggatgacagcgttctgacgaaggaggaaattgacgcaaggttgcagagaaaggtggaggcagtcgtcaagagagaaagggccatggcgtattcgtattcccaccagctgtggaaagcctcaccaaaatctgctcagtcatctctcatggatatccgttccaatggatttccatggtggtggaactggttagaacgtcagctacctccaacgaatcctcctgaaagccaagccttgaagaattttcaacttacaccgccaaggccacattcagagataaagcctagcccaagacccccatcaagtagccacaagcaacaacatctggggtttgataatatggatactcccacaccaagatcctcaaaatcaactgcatttgtatcaacaagaccagcgcgaactcctctacttagaactccacaagcaaacagccctagcttgtcaagatattcaagagcaagagccagtggagggaattctcctttcgacttgccattgaaggatgacgatagcctcacgagctgcccaccattttcagtgccaaactacatgactcctacggcctcagccaaggcaaaaacaagagcttatagtaatcccaaagagaggtttccagggaccccaaacagtgaaaagaggagactctcgttccctcttacacaaggcattggatctttcaagtggaacaaaggctccttcttcaccagcaaggattcaagctctcaaaggggtttagataagcatcagtcacttcaatccataggagatttgagtgtggattcaaccgtctcgatgcctgctacggttggacgaaggccatttaaccgatttgtgtga

SEQ ID NO: 74 - protein, 528 aa, Populus trichocarpa
MGKKGSWFSAIKRVFLPNSKDKLANESDKRSAKEKKKKGRGKLRHGETTSFIPLFREPSSIEKILDEAEREHKLIFRPPTPPEQPTTPPFVPPRSASPRVASQRVTSPRAASPRAASPRVASPRAASPRNAQRHKEIYYRPEPTLRNHHASATKIQAAYRGYVARRSFRALKGLVRLQGVIRGQNVKRQTMNAMKYMQLLVRVQSQIQSRRIQMLENQARRQAQNKNDKEVDGTLGKWGQSPEAGNSEDWDDSVLTKEEIDARLQRKVEAVVKRERAMAYSYSHQLWKASPKSAQSSLMDIRSNGFPWWWNWLERQLPPTNPPESQALKNFQLTPPRPHSEIKPSPRPPSSSHKQQHLGFDNMDTPTPRSSKSTAFVSTRPARTPLLRTPQANSPSLSRYSRARASGGNSPFDLPLKDDDSLTSCPPFSVPNYMTPTASAKAKTRAYSNPKERFPGTPNSEKRRLSFPLTQGIGSFKWNKGSFFTSKDSSSQRGLDKHQSLQSIGDLSVDSTVSMPATVGRRPFNRFV

SEQ ID NO: 75 - DNA, 1593 bp, Populus trichocarpa
  CDS (1)..(1593): Gene (Potri.019G095700), encoding a calmodulin-binding family protein; similar to SF16 protein (Helianthus annuus) GI:560150; [ co-ortholog (2of3) of At3g59690, At2g43680]
atgggaaagaaagggagttggttttcagcaatcaagagggtcttttcaccccactccaaggacaaactagctagtgaatcagataagagaagcacgaaagaaaagaagaagaagggtcttggaaaactaagacatggagagaccacttcattcattcccctgtttagagaaccaagcagtattgagaaaattttggatgaggctgaaagagagaataaattaattttcaggcctccaacgcctcctgaggaactgacaacaccaccttttgtgcctccaagagccgattctccgagggttgcttctcaaagagtcacctctccaagagctgctactccaagagctgtttcccctagagcggcatctccaagggttgcttcccctagagcagcttctcctaggaatgctcaacgccataaggagatatattacagaccagaaccaactctaagaaaccatcatgcttcggctaccaagatccaagcagcctatagaggctatgttgcaaggaggagcttcagagcactgaagggtcttgtgaggcttcaaggagtgataagaggacagaatgtgaagcggcagacaatgaatgcgatgaaacacatgcagctcttggtgcgggtccagtctcagattcagtctcggaggatccagatgttagaaaaccaagcacgacgtcaagctcaaaacagaaatgataaagaagtggatagtaccttgggcaaatggggccagttgtctgaggcaggtaataacgaagactgggatgacagcgtgctgacaaaggaggaaattgacgcaaggttgcagaaaagggtggaggcagtcgtcaagagagaaagagccatggcttatgcatattcccaccagctgtggaaagccactccaaaatctgctcagtcagctctaatggatatccgttccaatgggtttccatggtggtggaactggttagagcgtcagctacctccaactaatcctcctgaaagccaagccttgaggaattttcaacttacaccaccaaggccacgttccgatatgaaggctagccctaggcccccatccaggagccacaagcaacaacattttgggtttgataatatggatactccaacaccgagatcctcaaaatcaactgcttttgtgccaacgagacaagcgcgaactcctctacatagaacaccacaagccaacagccctagcttgtcaaaatattcaatggcaagagccagtgcagcaaattctccttttaacttgccattgaaggatgacgatagcctcatgagctgcccaccattttcagtgccaaactacatgagccctacagtttcagccaaagccaaagaaagagctaatagcaatcccaaggagaggtttccagggaccccaaccagtgaaaagaggagactgtcattccctcttacacagggcattgggtctttcaagtggaacaaaggctccttcactagcaaggattcaagttctcaaaggggtttagataggcatcagtcacttcaatccataggaaacttgagtgtggattcaaccgtctcgatgcctgccacgcgaaagccatttaaccgattcgtgtga

SEQ ID NO: 76 - protein, 530 aa, Populus trichocarpa
MGKKGSWFSAIKRVFSPHSKDKLASESDKRSTKEKKKKGLGKLRHGETTSFIPLFREPSSIEKILDEAERENKLIFRPPTPPEELTTPPFVPPRADSPRVASQRVTSPRAATPRAVSPRAASPRVASPRAASPRNAQRHKEIYYRPEPTLRNHHASATKIQAAYRGYVARRSFRALKGLVRLQGVIRGQNVKRQTMNAMKHMQLLVRVQSQIQSRRIQMLENQARRQAQNRNDKEVDSTLGKWGQLSEAGNNEDWDDSVLTKEEIDARLQKRVEAVVKRERAMAYAYSHQLWKATPKSAQSALMDIRSNGFPWWWNWLERQLPPTNPPESQALRNFQLTPPRPRSDMKASPRPPSRSHKQQHFGFDNMDTPTPRSSKSTAFVPTRQARTPLHRTPQANSPSLSKYSMARASAANSPFNLPLKDDDSLMSCPPFSVPNYMSPTVSAKAKERANSNPKERFPGTPTSEKRRLSFPLTQGIGSFKWNKGSFTSKDSSSQRGLDRHQSLQSIGNLSVDSTVSMPATRKPFNRFV

SEQ ID NO: 77 - DNA, 1593 bp, Populus trichocarpa
  CDS (1)..(1593): Gene (Potri.019G112400), encoding a IQ calmodulin-binding motif
atgggaaagaaagggagttggttttcagcaatcaagagggtcttttcaccccactccaaggacaaactagctagtgaatcagataagagaagcacgaaagaaaagaagaagaagggtcttggaaaactaagacatggagagaccacttcattcattcccctgtttagagaaccaagcagtattgagaaaattttggatgaggctgaaagagagaataaattaattttcaggcctccaacgcctcctgaggaactgacaacaccaccttttgtgcctccaagagccgattctccgagggttgcttctcaaagagtcacctctccaagagctgctactccaagggttgcttcccctagagcggcatctccaagggttgcttcccctagagcagcttctcctaggaatgctcaacgccataaggagatatattacagaccagaaccaactctaagaaaccatcatgcttctgctaccaagatccaagcagcctatagaggctatgttgcaaggaggagcttcagagcactgaagggtcttgtgaggcttcaaggagtgatacgaggacagaatgtgaagcggcagacaatgaatgcgatgaaacacatgcagctcttggtgcgggtccagtctcagattcagtctcggaggatccagatgttagaaaaccaagcacgacgtcaagctcaaaacagaaatgataaagaagtggatagtaccttgggcaaatggggccagttgtctgaggcaggtaataacgaagactgggatgacagcgtgctgacgaaggaggaaattgacgcaaggttgcagaaaagggtggaggcagtcgtcaagagagaaagagccatggcttatgcatattcccaccagctgtggaaagccactccaaaatctgctcagtcagctctaatggatatccgttccaatgggtttccatggtggtggaactggttagagcgtcagctacctccaactaatcctcctgaaagccaagccttgaggaattttcaacttacaccaccaaggccacgttccgatatgaaggctagccctaggcccccatccaggagccacaagcaacaacattttgggtttgataatatggatactccaacaccgagatcctcaaaatcaactgtttttgtgccaacgagacaagcgcgaactcctctacatagaactccacaagccaacagccctagcttgtcaaaatattcaatggcaagagccagtgcagcaaattctccttttaacttgccattgaaggatgacgatagcctcatgagctgcccaccattttcagtgccaaactacatgagccctacagtttcagccaaagccaaagaaagagctaatagcaatcccaaggagaggtttccagggaccccaaccagtgaaaagaggagactgtcattccctcttacacagggcattgggtctttcaagtggaacaaaggctccttcactagcaaggattcaagttctcaaaggggtttagataggcatcagtcacttcaatccataggaaacttgagtgtggattcaaccgtctcgatgcctgccacgcgaaagccatttaaccgattcgtgtga

SEQ ID NO: 78 - protein, 530 aa, Populus trichocarpa
MGKKGSWFSAIKRVFSPHSKDKLASESDKRSTKEKKKKGLGKLRHGETTSFIPLFREPSSIEKILDEAERENKLIFRPPTPPEELTTPPFVPPRADSPRVASQRVTSPRAATPRVASPRAASPRVASPRAASPRNAQRHKEIYYRPEPTLRNHHASATKIQAAYRGYVARRSFRALKGLVRLQGVIRGQNVKRQTMNAMKHMQLLVRVQSQIQSRRIQMLENQARRQAQNRNDKEVDSTLGKWGQLSEAGNNEDWDDSVLTKEEIDARLQKRVEAVVKRERAMAYAYSHQLWKATPKSAQSALMDIRSNGFPWWWNWLERQLPPTNPPESQALRNFQLTPPRPRSDMKASPRPPSRSHKQQHFGFDNMDTPTPRSSKSTVFVPTRQARTPLHRTPQANSPSLSKYSMARASAANSPFNLPLKDDDSLMSCPPFSVPNYMSPTVSAKAKERANSNPKERFPGTPTSEKRRLSFPLTQGIGSFKWNKGSFTSKDSSSQRGLDRHQSLQSIGNLSVDSTVSMPATRKPFNRFV

SEQ ID NO: 79 - DNA, 1596 bp, Eucalyptus grandis
  CDS (1)..(1596): Gene (Eucgr.H00308), encoding a IQ calmodulin-binding motif
atgggaaagaaaggtagctggttttctgcaatcaaaagggtcttcacaccccactcaaaggagaaactagtcaatgaatcagagaagaaatcttcaaagaaggacaagaaaaaggggcaagcgaagcagagacatggagagacaaattcattcattccgttcttcagagagccgagcagcatcgagaagatcctgggagatgccgagagagagcacaaaatcgtttatagacctgccacgccccctcttcctgagcaaccacggacatcttcagcttatgtggctcctcgagtggcttctcctcgggctccttctccaaaggttgcttcacctaaagctgcatctccgagggctgcttctcctagagttgctactccaaaaccagcttctcccaggattcatcagagagaaattattaggcaacggccagaaccgactttgcagaatcaccaagcttcagctaccaagattcaatcagcatttagaggctacatggcaaggaggagcttcagagcacttagaggtttagtgaggcttcaaggagttgtaagagggcaaaatgtgaagcgccagacggcgaatgccttgaagtacatgcagcttcttgtgcgagttcagtcacagattcaatcacggagaattcagatgctagagaaccaactacgtcatcaggctcagtacaggaatgacaaggaagtggatagccaattcggcaaatggagccaagcctctgaagcaggtaatcacgatgactgggacgatagcttgcttacgaaagaggaaattgaggcgaggttgcacagaaaggtggaggcgcttatcaaaagagagagagcaatggcttatgcatattctcatcagctatggaagagcactcctaaatcagcccatatggcctccatgtccatcccaacagggcgattcccttggtggtggagttggttggaccgtcagttaccatcttcaaatcctgtagaaagccaacctctgaactttcaactcacaccccccaggccaaacaccgacctgaagccgagcccatggaccccaccaagcagcaacaaaatgcagcttttcggtcttgacagcatcgaaacgccaaaatcatcgaggtccgtggttgtaatgccatcaaaacaagtccggaccccaccttcaagtcgaatacctgtgggtggcagttcaactgcatcaaagttttcgagatcaagggtcaatggagccgaatctccattcgatctgccatcaaaggatgatgacagtctcaccagctgccctccattttccgttcccagttatatggctcccacggtttcggccaaggccaaagtcagaggcgggagtaatcctagagagaggttccctgtgactccaggcagcgattcaaacaggcgtatctcgttcccccttgcacaaggcattgggtctttcaagtggaacaaaggctctttgttctctggaaaggactctggctctcaaagggtattggacaagcaccagccattgcattcgatcgggaatgtgagcgtggactcaaccgtctctttgcctgcaggagttggtactggaaggaagccatttaacagatttgtgtga

SEQ ID NO: 80 - protein, 531 aa, Eucalyptus grandis
MGKKGSWFSAIKRVFTPHSKEKLVNESEKKSSKKDKKKGQAKQRHGETNSFIPFFREPSSIEKILGDAEREHKIVYRPATPPLPEQPRTSSAYVAPRVASPRAPSPKVASPKAASPRAASPRVATPKPASPRIHQREIIRQRPEPTLQNHQASATKIQSAFRGYMARRSFRALRGLVRLQGVVRGQNVKRQTANALKYMQLLVRVQSQIQSRRIQMLENQLRHQAQYRNDKEVDSQFGKWSQASEAGNHDDWDDSLLTKEEIEARLHRKVEALIKRERAMAYAYSHQLWKSTPKSAHMASMSIPTGRFPWWWSWLDRQLPSSNPVESQPLNFQLTPPRPNTDLKPSPWTPPSSNKMQLFGLDSIETPKSSRSVVVMPSKQVRTPPSSRIPVGGSSTASKFSRSRVNGAESPFDLPSKDDDSLTSCPPFSVPSYMAPTVSAKAKVRGGSNPRERFPVTPGSDSNRRISFPLAQGIGSFKWNKGSLFSGKDSGSQRVLDKHQPLHSIGNVSVDSTVSLPAGVGTGRKPFNRFV

SEQ ID NO: 81 - DNA, 1686 bp, Eucalyptus grandis
  CDS (1)..(1686): Gene (Eucgr.L00007), encoding a IQ calmodulin-binding motif
atggggaagagagggagttggtttgctgctatcaaaaggattttcgtaaccaattccaaggagaaaccaaccaatgacacaaaggtaaaagaatcgaaaggaaagaagaaaaaggagccgagacaactgaagtatggagagaggaagtcattcaagattccgctcttcagagagcctagcagcatcgaggagatactgggagaagccgaaagagggcacgatattctatttcagcctcccacgcctccagagcaactgcaaacgcagttgattgtgcctcctcgagtagcttcaacaagcaatccgtctcaaagggctgcttctcctagagttgtttctccgagagccacttcacctagagttgcctcaccaaaggtagcatcaccgagagctgctttgccaagagttggttcgcctagatctacctcccaaagagctgcttcgcctcgagctgcttcaccaagacctgcatctcccagggttgcttcttccagagctacttcttctaggagctttaatcatcagaaggaagtcattgtccaaccagaactgagcatacctgtccagcttgcttcagctattaagattcaagctgccttcagagggtatatggcaagaaaaagcttcagagctctaagaggcttggtaagacttcaaggagtcataagagggcagactgtcaggcgacaaacgatgaatgcctcaaagcaaatgcatctttgtgtgcgagttcagtcgcagattcgatcttggaggattcagaggttagaaaaccaagcacggaatcaagctcagtacaagaacgacaaggaagtggaaagcacctgtggcaaatggagcctagcgtctgaggcaggtaacagagagggctgggacgagaccgtgcacacaaaggaggaaagagaggtgaggcttcaaaggaaggcggaggcagccatcaagagagagagagcaagggcttacgcgtactctcgtcagttatcgagagctaattctagaatggctcaaacatctccggcagacatccaatcaggcgtatttccttggtggtggaactggatagaacgacaacttcccttgtccaatccggctgaaaaccaatccgtgaagagtttccgcctcacaccaccgaggcgaaactctgagccaaagccgagtccaaggatactctctagcaaccacaagcttcagacacctgataattttgacgccaccacaccaagatcatcgagatcgatgatggtttggtcgtcaaagcaaggacgggcgacgccaacgggaacaccaaggaccagcagtccaagcataagcaagtattcgatgccaagagctagcgaacccgtatctccctttggtttgccgatgagggatgacgaaagcctcactagttgcccgccatttttggtcccaaactacatgactccaaccgtctctgccagagcaaaagcaagagctaacagcaatcctaaagaaaggcgtccgggcactcctagcagcgaatctagcaggcgtctctcgtacccttttacacgaggaatcggatcagcatttgcttggaacaaaggctccggctctcaaaacgcctcaaataatgatcagcacgaccggcagtccatcgggaacatgagcgtcggttcgaccgcgtcttccatggttgggaggaagccatttaacagattcgtgtga

SEQ ID NO: 82 - protein, 561 aa, Eucalyptus grandis
MGKRGSWFAAIKRIFVTNSKEKPTNDTKVKESKGKKKKEPRQLKYGERKSFKIPLFREPSSIEEILGEAERGHDILFQPPTPPEQLQTQLIVPPRVASTSNPSQRAASPRVVSPRATSPRVASPKVASPRAALPRVGSPRSTSQRAASPRAASPRPASPRVASSRATSSRSFNHQKEVIVQPELSIPVQLASAIKIQAAFRGYMARKSFRALRGLVRLQGVIRGQTVRRQTMNASKQMHLCVRVQSQIRSWRIQRLENQARNQAQYKNDKEVESTCGKWSLASEAGNREGWDETVHTKEEREVRLQRKAEAAIKRERARAYAYSRQLSRANSRMAQTSPADIQSGVFPWWWNWIERQLPLSNPAENQSVKSFRLTPPRRNSEPKPSPRILSSNHKLQTPDNFDATTPRSSRSMMVWSSKQGRATPTGTPRTSSPSISKYSMPRASEPVSPFGLPMRDDESLTSCPPFLVPNYMTPTVSARAKARANSNPKERRPGTPSSESSRRLSYPFTRGIGSAFAWNKGSGSQNASNNDQHDRQSIGNMSVGSTASSMVGRKPFNRFV

SEQ ID NO: 83 - DNA, 1554 bp, Arabidopsis thaliana
  CDS (1)..(1554): Gene (AT3G59690), encoding a IQ calmodulin-binding motif
atggggaagaaaggaagttggttttctgcaatcaaaagggtgttcacaccacattccaaagagaagcagctaagcaacaacaaccaagaaccagagataaagagtgaaaacaaagaaaagaagaagaaaggttttggaaagaaactaaggaatggagaaaccaattcatttcttcccatttttagacagcctagtagtatcgaaaagatcttgtctgaagccgaacgagagcataaccttgtctttaggccaccaactcccactgatcgagcaaattcatcatcaacctctgttgcatctcctcttgttaggcctgcttctcctaaagtgccttctcaaagatatgtctcttctccaaaacccatttccccaagagttgcttaccctcaagtccattatccgaagcccccttctccaaagccgccttctccaagagcggtttcgcctaggattgtgcagcgacgtgagtttgtgcatagaccagagccaagtctattggtcaaaaatgcttatgcaattaagattcaagcagcttttagaggttacatggcaaggaggagtttcagagctttgaaaggtctagtcaggcttcaaggagtggtaagaggacacagcgtgaagcgtcaaacgatgaatgctatgaagtatatgcagcttttagtccgagtccaaacacaagtccagtcacgtcgcatccaaatgctcgaaaaccgagctaggaacgataaagatgacacgaaattagtctctagtcgtatgtctgacgattgggacgatagcgtgctgacaaaagaagaaaaagatgtgaggcttcataggaagattgatgcaatgatcaaaagagaacggtccatggcctatgcttattctcaccagttatggaaaaacagtccaaagtctgctcaggacattagaacaagtgggttcccactttggtggaactgggtggaccggcagaagaatcaaaaccaaccgttcaggctaacaccaacacgaccgagcctgagccctcagcctcaatctagcaaccaaaaccatttcaggctcaacaacagtttcgacacgtcaacacccaattcatcaaaatccacattcgttactccatctagacccattcatactccgcaaccatacagtagcagcgtctcaagatactcacgaggaggaggacgagctacacaagattctccttttaaagatgatgatagcctcacaagctgtcctccattctcagctccaagctacatggctccaacagtctcagctaaagcaaaactaagagcaaacagcaatccaaaggagagaatggaccgtacaccggtcagcacaaacgagaagagacgaagttcgttccctcttggttcgttcaaatggaacaaagggtcattgttcatgagcaacaacagtaacaacaagggtccaggttcttcttcttctggtgctgtggtgcttgagaagcacaaaaccctcaaatccgttggaaatttgagtattgattctactgtttcgatgcctgcaacaattgggaggagggcttttaacagatttgcgtga

SEQ ID NO: 84 - protein, 517 aa, Arabidopsis thaliana
MGKKGSWFSAIKRVFTPHSKEKQLSNNNQEPEIKSENKEKKKKGFGKKLRNGETNSFLPIFRQPSSIEKILSEAEREHNLVFRPPTPTDRANSSSTSVASPLVRPASPKVPSQRYVSSPKPISPRVAYPQVHYPKPPSPKPPSPRAVSPRIVQRREFVHRPEPSLLVKNAYAIKIQAAFRGYMARRSFRALKGLVRLQGVVRGHSVKRQTMNAMKYMQLLVRVQTQVQSRRIQMLENRARNDKDDTKLVSSRMSDDWDDSVLTKEEKDVRLHRKIDAMIKRERSMAYAYSHQLWKNSPKSAQDIRTSGFPLWWNWVDRQKNQNQPFRLTPTRPSLSPQPQSSNQNHFRLNNSFDTSTPNSSKSTFVTPSRPIHTPQPYSSSVSRYSRGGGRATQDSPFKDDDSLTSCPPFSAPSYMAPTVSAKAKLRANSNPKERMDRTPVSTNEKRRSSFPLGSFKWNKGSLFMSNNSNNKGPGSSSSGAVVLEKHKTLKSVGNLSIDSTVSMPATIGRRAFNRFA

SEQ ID NO: 85 - DNA, 2010 bp, Arabidopsis thaliana
  CDS (1)..(2010): Gene (AT2G43680), encoding a IQ-domain 14, plasma membrane, calmodulin binding
atggtgaagaaaggaagttggttttctgctatcaaaagggtttttactccacattccaaagagaagctagccaatcaggaaccagagagaaagagtggcaaagaaaagaagaagaaaggttttgggaagctaaggcatggcgagaccaattcatttcttcccatcttcagagagcctagtagtatcgaaaagatcttgggcgaggctgagagagatcacaatcttgtcttcaggcctcctactcctgatcgaccaaatccatattcagcctctcctcctccgaggcctgcttctcctcgggttgcttccccaagaccaacttctccaagagttgcctcaccacgagtcccttctccaagagctgaagttccaagaaccctttcaccaaagcctccttctccaagagctgaagttccaagatccctttcaccaaagcctccttctccaagagctgaccttccaagatcactttcgccaaagccctttgatcgatcgaagccatcatcagcctctgctaatgcccctcctactcttaggcctgcttctactcgagttccttctcagagaattacacctcacagtgttccttctccaagaccaagttcaccaagaggtgcctccccacaagccatctcttcaaagccgccttctccaagagcagagccaccaacattggacactccaagacctccctctccaagagctgcttctctaagagcagacccaccaagattggatgctgcacgacccaccacgcctaggcctccttctccactagcagacgcaccaagattggatgctccacgacccactacgcctaagccgccttctccaagatcagacccgccaagattggatgctccaagacccactacgcctaagcccccttctccaagatcggtttctcctagggctgtgcagcggcgggagattgtttatagaccagagccaacgcttccggtccaacatgcttctgcaacaaagattcaaggagctttcagaggttacatggcaaggaagagtttcagagctctcaaaggtctagtcagacttcaaggtgtggtgagaggatacagcgtgaagcggcagacgataaatgcaatgaagtacatgcagcaagtggtccgtgttcaatcccaaatccagtcacgtcgcatcaaaatgttggaaaaccaagcccaggtagagaaagatgaagccaaatgggctgcgtctgaagctggtaatgataattgggatgacagtgtgctgacaaaagaggaaagggattcaagatcacaaagaaagactgacgcaatcatcaagagagaaagatccatggcctatgcatattctcgcaagttgtggaagaacagtcctaagtctactcaggacaatcgttctttccctcaatggtggaactgggtggaccggcagaatcctcttgctagtcctgcaccgagctatagccaaccacaaagagatttcaggctaacaccatcaagactgtgcccaagtcctctgtctcagtcaagcaaacaacaccatatcaggcttgacaaccactttgacacttcaacacccagatcgtcaagatccacttttcacactccctccagacccatccacacagggacatcaagatactcaagaggaagactaagaggtcaagattctcctttcaaggatgatgatagcctcacaagctgccctccattccctagctacatggctccaacagtctctgccaaagcaaaagttagaccaaacagcaatccaaaggagagagtgatgggtacaccagtcagcgagaagaggagaatgtcgtatccccccacgcaagatacgtttagatggaacaaagggtcattggtcatgagcaacagcagcagccacagaggtcctggttcacctggaggtgtggttcttgagaagcacaagacacttaaatcagtaggaaatttgagcattggttccactgcctccatggcaacaacagttgggagaaaggaatttaacagatttgtgtga

SEQ ID NO: 86 - protein, 669 aa, Arabidopsis thaliana
MVKKGSWFSAIKRVFTPHSKEKLANQEPERKSGKEKKKKGFGKLRHGETNSFLPIFREPSSIEKILGEAERDHNLVFRPPTPDRPNPYSASPPPRPASPRVASPRPTSPRVASPRVPSPRAEVPRTLSPKPPSPRAEVPRSLSPKPPSPRADLPRSLSPKPFDRSKPSSASANAPPTLRPASTRVPSQRITPHSVPSPRPSSPRGASPQAISSKPPSPRAEPPTLDTPRPPSPRAASLRADPPRLDAARPTTPRPPSPLADAPRLDAPRPTTPKPPSPRSDPPRLDAPRPTTPKPPSPRSVSPRAVQRREIVYRPEPTLPVQHASATKIQGAFRGYMARKSFRALKGLVRLQGVVRGYSVKRQTINAMKYMQQVVRVQSQIQSRRIKMLENQAQVEKDEAKWAASEAGNDNWDDSVLTKEERDSRSQRKTDAIIKRERSMAYAYSRKLWKNSPKSTQDNRSFPQWWNWVDRQNPLASPAPSYSQPQRDFRLTPSRLCPSPLSQSSKQHHIRLDNHFDTSTPRSSRSTFHTPSRPIHTGTSRYSRGRLRGQDSPFKDDDSLTSCPPFPSYMAPTVSAKAKVRPNSNPKERVMGTPVSEKRRMSYPPTQDTFRWNKGSLVMSNSSSHRGPGSPGGVVLEKHKTLKSVGNLSIGSTASMATTVGRKEFNRFV

SEQ ID NO: 87 - DNA, 1557 bp, Populus trichocarpa
  CDS (1)..(1557): Gene (STT387), encoding a shikimate dehydrogenase
atggggcgtgctgggatcttagcaaattccacaatggtttgtgctccattgatggctcgatctgttgagcaaatggtgattgacatgcagagtgcagaggcacagggtgctgatgctgtggaggtcaggctggactacatcaacagcttccagcctagccaagacctggaaactatcatcagaaacaagccattgcccgtcatcattgtgtacaggccgaggtgggaaggtggtcagtatgaaggggatgagcacacaaggcttgaagcacttcgtttagcacatgaactgggagctgattatattgatgttgagctcaaggttgcatctgatctggtacgggaagtgaaaaacaagcatcagactggtggcaaagtcattgtatcatcttatttgagtggcgcaaccccttcaaaagaagatctcagccatcttgttgcgagcatgcaagctaccaaagcagatatcattaaagttgtttctaatgcaaatgatatcacagaattggataggatttttcatttgctttcacatatgcaggtgccagcggttgcatactcattaggggaaagaggcctcataagccagttattgtgtcccaaattcggtggtgctttagtctatggagccatggaaggaaattcaattcctggtttgcctactttagacagccttagagaagcctacaaggttgagaacatcaattcagatactaaagttttcggtcttgtttcaaaaccagttagccacagcaaaggccctatactgcacaatcctgccttcaggcatgcgaactttaatgggatttatgtgccaatgtttgttgatgatctcaaggagttctttgaagtctacgcaagccctgactttgctggttatagtgttgggtttccatacaaagaagctgtcgtgcagttctgtgacgaagtccatccactggctaagtctataggtgctgttaataccatcataaggaagcctagtgatgggaagctgataggttataacacagactgtgagggttcaatagcttcaattgaggatgctttgaaagatcaaagatacatcaatggcgcatctttaaattctccattggctgggaaacagtttgtggttgttggtgctggaggcgcaggaagagcaattgcagttggtgctaaaagtagaggagcccgtgtgattattttcgacattgatcttgacagggcaaagtctcttgctcaggttgtttctggtgaagctcaacattttgatagtctagcacatttccagcctgagaagggagcaatccttgccaatgcaacaccaataggaatgcatccaagtacagaccgaatcccggtggccgaggcaaccttggggaactaccagctggtattcgatgctgtttatacaccaagaaaaaccagactattagaagatgctgatgctgctggagccattacagtgagcggagttgagatgttcctcaaacaggccattggacagttcagcctcttcaccggcagagaagcgccgaaagacttcatgcgggagattgttctagccaaattctga

SEQ ID NO: 88 - protein, 518 aa, Populus trichocarpa
MGRAGILANSTMVCAPLMARSVEQMVIDMQSAEAQGADAVEVRLDYINSFQPSQDLETIIRNKPLPVIIVYRPRWEGGQYEGDEHTRLEALRLAHELGADYIDVELKVASDLVREVKNKHQTGGKVIVSSYLSGATPSKEDLSHLVASMQATKADIIKVVSNANDITELDRIFHLLSHMQVPAVAYSLGERGLISQLLCPKFGGALVYGAMEGNSIPGLPTLDSLREAYKVENINSDTKVFGLVSKPVSHSKGPILHNPAFRHANFNGIYVPMFVDDLKEFFEVYASPDFAGYSVGFPYKEAVVQFCDEVHPLAKSIGAVNTIIRKPSDGKLIGYNTDCEGSIASIEDALKDQRYINGASLNSPLAGKQFVVVGAGGAGRAIAVGAKSRGARVIIFDIDLDRAKSLAQVVSGEAQHFDSLAHFQPEKGAILANATPIGMHPSTDRIPVAEATLGNYQLVFDAVYTPRKTRLLEDADAAGAITVSGVEMFLKQAIGQFSLFTGREAPKDFMREIVLAKF

SEQ ID NO: 89 - DNA, 1557 bp, Populus trichocarpa
  CDS (1)..(1557): Gene (Potri.005G043400), encoding a Shikimate dehydrogenase substrate binding domain
atggggagtgttggagtcctgacaaattctgtaatggtttgtgctccattaatggctcaatctgttgagcaaatggtgatcgacatgcatagtgcaaaggcacaaggcgctgatgttgtggaggtcaggttggactgcattagcaagtttcagcctaggcaagacctggaaaccatcatcagaaacaagccattgccggtgatcattgtctacaggccaaagtgggaaggtgggcagtacgaaggggatgagcacagaaggttggaagcacttcgtttggcaaatgatctgggagctgattatattgatttggagcttaaggttgcctctgagctgatatgggaactgaaaaacaagcatcagaatggtgggaaagtcattgtatcatcttacttgaatggtgcaaccccctcgaaagaaaatctcagccatcttgttgcaaccatgcaagctactgaagcagatatcatcaaagttgtttctaatgcagatgatatcacagaaatggaaaggatttttcatttgctttcgcattgcgaggtgccagcagttgcatactctgtgggggagagaggcctcataagccagctgttgtgccccaaattcggtggtgctttagtctatggatccatggaaggaaattcaattcctggtttacctacattagacagccttagagaagcctacaaggttgactgcattaattcagatactaaagttttcggtcttgtttcaaagccagttggccacagcaaaggccctctgttgcataatcctaccctgagacatgtgaactttaatgggatctatgtccccatgtttgtcgatgatctcaagaagttctttgatgtctacgcaagccctgactttgctggttatagtgttgggtttccatacaaggaagctgtcgtgcagttctgtgatgaagtccatccactggctaagtgtattggagctgttaataccatcataaggaggccctgtgatgggaaactgataggttataatacagactgtgagggttcaataactgcaattgaggatgctttgagagatcagaaatacgtcaatggcagatccttaaattctccgttggctgggaaacagtttgtggtagttggtgctggaggtgctggaagagcaattgcagttggagctaagagtagaggagcccgtttaattattttcgacatcgatctcgagagagcaaagagtcttgctcgagctgtttctggtgaagctcaacattttgaaagtctagcacatttccagcctgagaatggggcaatccttgcaaatgcaacaccgattggaatgcatccgagtacagatcgaattcccgcggccgaggaaaccttggggaactaccaactggtattcgatgctgtttacacaccaagaaaaaccagactattaaaagatgctgatgcagctggagcaattacagtgagtggagttgagatgttcctcagacaggccatcgggcagttcaacctcttcaccggcagagaagctccgaaggacttcatgcgggagattgttttagccaaattctga

SEQ ID NO: 90 - protein, 518 aa, Populus trichocarpa
MGSVGVLTNSVMVCAPLMAQSVEQMVIDMHSAKAQGADVVEVRLDCISKFQPRQDLETIIRNKPLPVIIVYRPKWEGGQYEGDEHRRLEALRLANDLGADYIDLELKVASELIWELKNKHQNGGKVIVSSYLNGATPSKENLSHLVATMQATEADIIKVVSNADDITEMERIFHLLSHCEVPAVAYSVGERGLISQLLCPKFGGALVYGSMEGNSIPGLPTLDSLREAYKVDCINSDTKVFGLVSKPVGHSKGPLLHNPTLRHVNFNGIYVPMFVDDLKKFFDVYASPDFAGYSVGFPYKEAVVQFCDEVHPLAKCIGAVNTIIRRPCDGKLIGYNTDCEGSITAIEDALRDQKYVNGRSLNSPLAGKQFVVVGAGGAGRAIAVGAKSRGARLIIFDIDLERAKSLARAVSGEAQHFESLAHFQPENGAILANATPIGMHPSTDRIPAAEETLGNYQLVFDAVYTPRKTRLLKDADAAGAITVSGVEMFLRQAIGQFNLFTGREAPKDFMREIVLAKF

SEQ ID NO: 91 - DNA, 1563 bp, Eucalyptus grandis
  CDS (1)..(1563): Gene (Eucgr.B01770), encoding a Shikimate dehydrogenase substrate binding domain
atgggcagcctctccctctccagtgttggcctgaccatggtttgtgcacccgtaatgggtgaatctgttgaccaagtggttgaagaaatgcacaaggcgaaggcacaaggtgcagacgtagttgaggtcaggctggattgcatcaagcaatttcaggctcaccaggatcttgaaatcatcctcaagagcaagccgttaccggttatcattgtttacaggcctaaatgcgaaggggggctctatgaaggtgacgagacagcccggttggaagcacttcattctgctctgaaattaggtgctgattatgtcgatttcgagctcaaggttgctgctgaacttatgagtaagcagaataagttgcattgtggaggtaccaaagtgatagtttcatgctttttggatggcgtgaccccttcaaaagaagaacttagcaatcttgctacacatatgcaagctactggtgcagatattatcaaaattgtcactagtgcaagtaacatcacagaactggccagactttttcatatactgtcttatagccagatgccagtagttgcatatgctgttggagaaaggggtcttatcagccaattgttgagtcccaaatttggcagtaatttagtctatggctcaatagaaggaatggcagttcccggtcttcctactctggaaagcctaagaaaagcatacaaagttgagcacatcaattcagatacaaaagttttcggcctcatctcaaaaccagttggccacagcaaaggtccaattttgcataaccctacgctcagacatatgaatttcaatggactttatgtcccaatgttcgttgacaatcttaaagaattcttcgaagtatactctacccctgacttcgctggttttagtgtggggattccatacaaagaagccgtcattcagttttgtgatgaagtacatccactcgctcagaacataggtgctgttaacactatagtaaggaggcctagtgatgggaaattaatcgggtataacacagattgtgaggcttcagtaactgccatggaagatgctctgcaagaatgtcgatgcattaatggtgaaaagtctttggtttctccactggcgggcaaagagtttgtgctagttggcgctggaggtgcaggacgagctttggcttttggtgctaaaaccagaggagctcggatcattatttttgacatcgattttgaaagggcaaagatgcttgctcatgctgtttctggcgaagctaggccttttggggatttaccttatttccagccggagaaagggtcaattcttgctaatgcgacaccgatcggaatgcatccaaacaaggatcgaataccagtttctgaggcgagtttgggggttttccagctcgtcttcgatgctgtgtatacaccgagaaagaccactctactaaaggaagctgaggctgccggagcaattactgtgagtggagttgaaatgttcctcaggcaggccataggccagttcaatctctttaccggaggagaagcacccaaggagttcatgagggagatagttttggccaagttctga

SEQ ID NO: 92 - protein, 520 aa, Eucalyptus grandis
MGSLSLSSVGLTMVCAPVMGESVDQVVEEMHKAKAQGADVVEVRLDCIKQFQAHQDLEIILKSKPLPVIIVYRPKCEGGLYEGDETARLEALHSALKLGADYVDFELKVAAELMSKQNKLHCGGTKVIVSCFLDGVTPSKEELSNLATHMQATGADIIKIVTSASNITELARLFHILSYSQMPVVAYAVGERGLISQLLSPKFGSNLVYGSIEGMAVPGLPTLESLRKAYKVEHINSDTKVFGLISKPVGHSKGPILHNPTLRHMNFNGLYVPMFVDNLKEFFEVYSTPDFAGFSVGIPYKEAVIQFCDEVHPLAQNIGAVNTIVRRPSDGKLIGYNTDCEASVTAMEDALQECRCINGEKSLVSPLAGKEFVLVGAGGAGRALAFGAKTRGARIIIFDIDFERAKMLAHAVSGEARPFGDLPYFQPEKGSILANATPIGMHPNKDRIPVSEASLGVFQLVFDAVYTPRKTTLLKEAEAAGAITVSGVEMFLRQAIGQFNLFTGGEAPKEFMREIVLAKF

SEQ ID NO: 93 - DNA, 1758 bp, Eucalyptus grandis
  CDS (1)..(1758): Gene (Eucgr.H01214), encoding a Shikimate dehydrogenase substrate binding domain
atggcaaaactccatgcaactcctcaagcttcccgtgcaggggaatccaagagggaatatccgatccaccgcgagcgatcatggactgtatcgccgccggatcattggcggaaacaggtggccgagggcgtcaccgcccagactctacactcctcctcccgcatcttctttcttcactgcccgtcgtcccgaagagagaggccgagagaaatggacaggaatggcgtgctggtgtgcgctcccctggagtgcgagaccctggaagggatgctgtcctccatggacaaggccaaggcgcacggcgcggacctcgtcgagctccgcgtcgacgccatgtccttcggccgggtctccgaggtcgaggagctcatccggcgccgcacccttcccgccattgtctccttcaggttgaattccgcaagagcttcccgcagacaaaatgacaagaccacttgcttgcaagtgctgcggctagcgctcgaactggacgtcgagttcgtcgagatggaacacgaggtggtttctcacttcaacatcgatgaactgatggaaaagcgttcgagcagcaaaataatcgtgtcgagacacttgaatggcgacaaaccgtgcaaggagaagctcgggaacttaattgccttgatgcaatcctctggaggagacgttatcaagctccttgtcgatgttgattacatcacggatttagcaccgattttccagctcctcaccagttgccaggttccactaattgccaccacggttggcgacagagggctgataggccagttgctggggccaaagtttggcggcttcttggcgtatgggtcactggaaggagcaattcctggtctgccgacactgactagcctcaggcaagtgtacaagattgagcacatgaacgcggacaccaaggtcttcggcctcatatcgaacccagtcgggcacagcaaagggccgctcctccacaacccgaccttccgatatgtagggttcaacggtatctatgtccctatgctcgttgataacatcaaggagttcttcaaggtctataccagtcaagattttgcaggcttcagtgtgggaattccacataaggaagcagcagttgcttgctgtgatgaagttcatccactagctaagtccattggagctgtgaatactatagtaaggaggcctactgatgggaagctgattgggtacaacacagattgtgaggcttcaatcactgctatagaggatgctctgagagagaggcatgccgctaatggggaagccagagcaatggacgcatctccaattgcagggaaagcatttgtactggttggagctggaggagctggaagagctttggccttcggcgccaagagtcgcggggcccgagtcttcgtcttcaaccgcaacttcgagagagcaaaagccctagccgacgcggtatcgggagaagccatcaggtacgaacacttggacacgttccgccccgaggaagggatgatccttgcgaacgcatccgccgtcggaatggagccgcacgctgataagagccccgtttccaagggggtgctgggagcatatgagctggtgtttgatgcagtgtacacaccaaggaacacaaggctattgcaagaggcagcacaggcaggggccattgcggttagtgggatggagatgttcatcagacaggccctccatcaattcaaactcttcaccagcggcttagcaccggaggaattcatgcgcaagctcgtgttggaacaattctga

SEQ ID NO: 94 - protein, 585 aa, Eucalyptus grandis
MAKLHATPQASRAGESKREYPIHRERSWTVSPPDHWRKQVAEGVTAQTLHSSSRIFFLHCPSSRRERPREMDRNGVLVCAPLECETLEGMLSSMDKAKAHGADLVELRVDAMSFGRVSEVEELIRRRTLPAIVSFRLNSARASRRQNDKTTCLQVLRLALELDVEFVEMEHEVVSHFNIDELMEKRSSSKIIVSRHLNGDKPCKEKLGNLIALMQSSGGDVIKLLVDVDYITDLAPIFQLLTSCQVPLIATTVGDRGLIGQLLGPKFGGFLAYGSLEGAIPGLPTLTSLRQVYKIEHMNADTKVFGLISNPVGHSKGPLLHNPTFRYVGFNGIYVPMLVDNIKEFFKVYTSQDFAGFSVGIPHKEAAVACCDEVHPLAKSIGAVNTIVRRPTDGKLIGYNTDCEASITAIEDALRERHAANGEARAMDASPIAGKAFVLVGAGGAGRALAFGAKSRGARVFVFNRNFERAKALADAVSGEAIRYEHLDTFRPEEGMILANASAVGMEPHADKSPVSKGVLGAYELVFDAVYTPRNTRLLQEAAQAGAIAVSGMEMFIRQALHQFKLFTSGLAPEEFMRKLVLEQF

SEQ ID NO: 95 - DNA, 1812 bp, Arabidopsis thaliana
  CDS (1)..(1812): Gene (AT3G06350), encoding a dehydroquinate dehydratase, putative / shikimate dehydrogenase, putative
atggcagcttcttcaactaatgctcgtctcaccaaccctcctcgtctactctccaaaccccgactttcacctacctccgtcgccaatctccgttttccagccgccgatttctccactcgcttctttgccgattcttcgtccccgcggctaaggagtgtaccgtttccggtggtattttccgatcaaaggcgccggcgaagcatggaacctagcaatgtctatgtggcttcaaattccacggaaatggagatcggaagtcatgatatcgtgaagaatccgagcttgatctgtgctccagtgatggcggattcaatagacaagatggtgattgaaacgagtaaagcccatgaattgggtgcagacttggttgaaattcgattagattggctaaaggacttcaatcctcttgaggatctaaaaaccattattaagaaatctcctctacccactttattcacctacagaccaaaatgggaaggtggtcagtatgaaggtgatgaaaatgagagacgggatgtgcttcgtctggccatggagttgggagctgattatattgatgttgaacttcaggtggcaagtgagttcatcaaatctattgacggaaagaagcctggaaagttcaaagtaattgtttcatcgcacaactatcagaataccccttctgttgaggaccttgatggccttgttgcaagaatacaacagactggagccgacattgttaagattgctactactgctgtggacattgcagatgttgctcgcatgttccatataacctcaaaagctcaagttcccacaattggacttgttatgggtgaaagaggtttgatgtctcggattctttgttcgaaatttggtggttatttgacctttggcaccttagattctagtaaagtttctgcgccaggtcaaccaacgatcaaggatctgttggatctttacaactttagaagaattggtcctgacacaaaggtatatggaattattggcaagcctgtcagccacagcaaatcacctattgttcacaatcaagctttcaaatcagttgattttaatggagtatatgtccacctgttagttgataatcttgtaagctttcttcaagcatactcatcctctgatttcgctggattcagctgtacaattccgcacaaagaagctgcattgcaatgttgtgatgaagttgatccattggcaaagtctataggagctgtgaacactatactaaggagaaaaagtgacggaaagttgttgggttacaacacagattgtattggttccatttctgctattgaggatggcctacgaagttcaggtgatccaagcagtgtaccttcttcttcttcgccattggccagtaaaacagtggtggttattggtgctggtggagcaggcaaggctcttgcttatggtgcaaaagaaaagggggccaaagttgtaattgctaatcgaacttacgaacgagcactagaactcgcagaagcaataggaggcaaagcgttatctctgacagatttagataactatcacccagaagatggcatggttttggcaaacacaacatctatgggtatgcaaccaaatgttgaggagactccaatttctaaggatgcattgaagcactatgcactggtctttgatgcggtatacactccgagaatcaccagactgttgagggaagcagaagaaagtggagccataactgtctcagggtcagagatgtttgtcaggcaggcttacgagcagtttgagatcttcaccggtttacccgctccaaaggaactctactggcaaataatgtcaaagtactga

SEQ ID NO: 96 - protein, 603 aa, Arabidopsis thaliana
MAASSTNARLTNPPRLLSKPRLSPTSVANLRFPAADFSTRFFADSSSPRLRSVPFPVVFSDQRRRRSMEPSNVYVASNSTEMEIGSHDIVKNPSLICAPVMADSIDKMVIETSKAHELGADLVEIRLDWLKDFNPLEDLKTIIKKSPLPTLFTYRPKWEGGQYEGDENERRDVLRLAMELGADYIDVELQVASEFIKSIDGKKPGKFKVIVSSHNYQNTPSVEDLDGLVARIQQTGADIVKIATTAVDIADVARMFHITSKAQVPTIGLVMGERGLMSRILCSKFGGYLTFGTLDSSKVSAPGQPTIKDLLDLYNFRRIGPDTKVYGIIGKPVSHSKSPIVHNQAFKSVDFNGVYVHLLVDNLVSFLQAYSSSDFAGFSCTIPHKEAALQCCDEVDPLAKSIGAVNTILRRKSDGKLLGYNTDCIGSISAIEDGLRSSGDPSSVPSSSSPLASKTVVVIGAGGAGKALAYGAKEKGAKVVIANRTYERALELAEAIGGKALSLTDLDNYHPEDGMVLANTTSMGMQPNVEETPISKDALKHYALVFDAVYTPRITRLLREAEESGAITVSGSEMFVRQAYEQFEIFTGLPAPKELYWQIMSKY

SEQ ID NO: 97 - DNA, 1044 bp, Populus trichocarpa
  CDS (1)..(1044): Gene (STT543), encoding a 2-oxoglutarate-and Fe (II)-dependent oxygenase
atgggagaaatcgatccagaattcattcaagaaacagaatacaggcctaaattcaaaacaatagaagctgatgaagaaatcccagttattgatctctctgtttccactccaagtgccacaaaagaagttgtgtcaaagattggagaagcgtgcaagaagtggggattttttcaagtgatcaatcatggggtaccgttggaactaaggcaaaagatagagagggtagcaaaagaattctttgatcaaccgatggaggaaaaacggaaggtgaagagagatgaggtgaatcctatggggtatcatgatagtgagcacaccaaaaatattagggactggaaggaggtttttgacttcttggtggtagatccaactttaattcctgcctctggtgatcctgatgataaagagctaagggctatgactaatcaatggccacacaaaccttctgaattcagggagctgtgccaagaatatacaagacaggtggaaaaactagctttcaagttgctggagcttatctctttgagcttagggttgcctgctgataggttaaatggttacttcaaagaccaaatcagctttgctaggttcaaccattaccctccttgtcctgcaccccacctagctcttggtgtaggtaggcacaaggatggaggtgccttgacggtcttatcccaagatgatgttggagggctgcaaataggccgcagatcagatggagaatggatccctgttaaaccaattccagatgcctttatcatcaatattggtaattgtatgcaggtttggagcaatgacttgtactggagtgcagagcatagagtggtggtgaattctcaaagggaaaggttctcgataccattcttctttttcccatcccaatatgttgatattaagccactggatgagctaattaatgagcaaaaccttgcaaagtacaaggaattcaactggggaaaattctttgccagtagaaaccgcagtgattataaaaaacgtgaagtggaaaacatccaaatcgatcactttaaggtaccagagtga

SEQ ID NO: 98 - protein, 347 aa, Populus trichocarpa
MGEIDPEFIQETEYRPKFKTIEADEEIPVIDLSVSTPSATKEVVSKIGEACKKWGFFQVINHGVPLELRQKIERVAKEFFDQPMEEKRKVKRDEVNPMGYHDSEHTKNIRDWKEVFDFLVVDPTLIPASGDPDDKELRAMTNQWPHKPSEFRELCQEYTRQVEKLAFKLLELISLSLGLPADRLNGYFKDQISFARFNHYPPCPAPHLALGVGRHKDGGALTVLSQDDVGGLQIGRRSDGEWIPVKPIPDAFIINIGNCMQVWSNDLYWSAEHRVVVNSQRERFSIPFFFFPSQYVDIKPLDELINEQNLAKYKEFNWGKFFASRNRSDYKKREVENIQIDHFKVPE

SEQ ID NO: 99 - DNA, 1041 bp, Eucalyptus grandis
  CDS (1)..(1041): Gene (Eucgr.I01206), encoding a 2-oxoglutarate (2OG) and Fe(II)-dependent oxygenase superfamily protein
atgggtgctctcgacgctgccttcatccaagaagccgagcagaggcccgacctcaagatggtggaaggcgaaggcatccccatgatcgacctctccgactcgcccgcccggacccgggaagagctcgccgcggagatcggggacgcgtgcaagaagtggggcttcttccaggtggtcaaccacggggtccccctgggcctccgcaagagggtggaggagctggtcaaggagttcttcgatcagccccccgaggagaaggagaaagtgaagagggacgaggtccatcccatggggtaccacgacagcgaacacaccaagaacgtgagggactggaaggaggtcttcgatttcttcttgcaggaccccactctgatccctgctctgtctcaccccgaggacaagtccctgaggaagctgaccaatcagtggccccaaagccccccgcaattcagagagacgtgtgaggagtatgcaagagaagtggagaaccttgcgtttaagttgctggagctgatctctctcagtttggggctgccagcggataaatttaatggctacttcaaagagcagaccagctttctcaggttcaatcactatcctccgtgcccccagcctgagttggctctcggggttggccgacacaaggatggtggggccctgaccgttctttcccaagactctgtgggaggcctccagatacagcggagatcagatggagagtggatttcaataaggccgacacctgatgcttatgtaatcaatcttggcaatgctatgcaggtttggacgaacgacttgtactggagcgcggagcacagagtggtggttaacacagagaaggagagattctccgttccttttttcttcttcccaggccatcaagtctcggtgaagccactggacgagataacgaacgaggagaatcctcccaagtacaaggagttcaactggggcgtgttcttcgcgatgagaaaccgaagcgactacaagaagcaagaggtcgagaacatccaaatcgaccatttcaaggtatcggagtga

SEQ ID NO: 100 - protein, 346 aa, Eucalyptus grandis
MGALDAAFIQEAEQRPDLKMVEGEGIPMIDLSDSPARTREELAAEIGDACKKWGFFQVVNHGVPLGLRKRVEELVKEFFDQPPEEKEKVKRDEVHPMGYHDSEHTKNVRDWKEVFDFFLQDPTLIPALSHPEDKSLRKLTNQWPQSPPQFRETCEEYAREVENLAFKLLELISLSLGLPADKFNGYFKEQTSFLRFNHYPPCPQPELALGVGRHKDGGALTVLSQDSVGGLQIQRRSDGEWISIRPTPDAYVINLGNAMQVWTNDLYWSAEHRVVVNTEKERFSVPFFFFPGHQVSVKPLDEITNEENPPKYKEFNWGVFFAMRNRSDYKKQEVENIQIDHFKVSE

SEQ ID NO: 101 - DNA, 1059 bp, Arabidopsis thaliana
  CDS (1)..(1059): Gene (AT3G19000), encoding a 2-oxoglutarate (2OG) and Fe(II)-dependent oxygenase superfamily protein
atgggagaactcgacgaagcttttatccaagctccagaacacagacccaacactcacctcacaaactccggtgatttcattttctccgacgagatcccgaccatcgacctctcttctctcgaagatactcatcatgacaagactgcgatcgccaaggagattgcagaggcatgcaagagatggggattttttcaagtgatcaaccatggcttgccttcagctttaaggcatcgtgtagagaagacagctgctgagtttttcaatctaacgacggaggagaagaggaaagtgaaaagagacgaagtgaatcctatgggttatcacgacgaagaacacactaagaacgttagagattggaaggaaattttcgatttcttcttacaagattccacgatcgttccggcgtcaccggagccggaagatactgagctccgaaagctcacgaaccagtggcctcaaaacccttctcatttcagagaggtatgccaagaatatgcaagagaagttgagaagttagcttttaggctattggaacttgtctccattagtttgggtctacctggtgatcggctaaccggtttcttcaatgagcaaactagttttttgcggtttaaccattaccctccttgcccgaaccccgagctagcattaggtgttggacgtcacaaagatggaggagctttaaccgtcctggcccaagatagtgtaggtggattacaagtgagtcgtagatcggatggacaatggatccccgtgaaaccgatctcggatgctttgatcattaacatgggcaattgtattcaggtgtggacaaatgatgagtattggagtgctgaacatagagtggtcgtgaatacaagcaaagagagattctcaataccattcttcttcttcccatcacatgaagccaatattgagccattggaggagcttataagtgaggaaaacccgccttgttataaaaagtacaattggggaaagttctttgtttcaagaaacagaagtgatttcaagaaactcgaggttgagaatatccagattgatcacttcaaggcttag

SEQ ID NO: 102 - protein, 352 aa, Arabidopsis thaliana
MGELDEAFIQAPEHRPNTHLTNSGDFIFSDEIPTIDLSSLEDTHHDKTAIAKEIAEACKRWGFFQVINHGLPSALRHRVEKTAAEFFNLTTEEKRKVKRDEVNPMGYHDEEHTKNVRDWKEIFDFFLQDSTIVPASPEPEDTELRKLTNQWPQNPSHFREVCQEYAREVEKLAFRLLELVSISLGLPGDRLTGFFNEQTSFLRFNHYPPCPNPELALGVGRHKDGGALTVLAQDSVGGLQVSRRSDGQWIPVKPISDALIINMGNCIQVWTNDEYWSAEHRVVVNTSKERFSIPFFFFPSHEANIEPLEELISEENPPCYKKYNWGKFFVSRNRSDFKKLEVENIQIDHFKA

SEQ ID NO: 103 - DNA, 1050 bp, Arabidopsis thaliana
  CDS (1)..(1050): Gene (AT3G19010), encoding a 2-oxoglutarate (2OG) and Fe(II)-dependent oxygenase superfamily protein
atggaggatcttgatccaacctacatccaagcaccagagcatagatcagattcgaatttcatccctaaccaaccagaagaaatacccgtgattgatctctcgcgcctcgatgaccccgaagatgtccaaaacgttatctcagagatcggtgatgcttgtgaaaaatggggattttttcaggtgcttaatcatggtgtgccttctgacgcaaggcaacgtgtggagaagactgtgaagatgtttttcgatttgcctatggaagagaagataaaggtgaagagagacgatgtgaatcctgtagggtatcatgatggagaacacaccaagaacgttaaagattggaaagaagtgtttgatatttatttcaaagatccaatggtcattccttcaaccactgatcctgaagatgaaggcttaagacttgtttacaacaagtggcctcaatctccttctgatttcagggaagcatgtgaagtatatgcgagacacgctgaaaaattagcgttcaagctcttggaactgatttcgttaagcttaggcttgccaaaagagcgttttcatgactacttcaaagaacaaatgagttttttcaggataaatcgttatccaccatgtccaagacctgacctagctttaggtgttggtcaccacaaagatgccgacgttattagtctattggctcaagatgatgttggaggattacaagttagtcgtagatcggacggtgtttggtttccgattagacccgtccctaatgctcttgtcatcaatataggcaattgtatggagatatggacgaatgacaagtattggagtgctgaacatagagtggtggtgaacacaacaagagagagatactcgataccattcttcttgttgccttcacacgatgtggaagtgaagccattagaagaacttgtgagtcctgaaaaccctccaaaatacaaaggctataaatggggtaagttctacgtcagtaggaatagaagcgattttcgaaaactggaaatcgaaaacatccaaatcgatgacttcaaagttaaaacttaa

SEQ ID NO: 104 - protein, 349 aa, Arabidopsis thaliana
MEDLDPTYIQAPEHRSDSNFIPNQPEEIPVIDLSRLDDPEDVQNVISEIGDACEKWGFFQVLNHGVPSDARQRVEKTVKMFFDLPMEEKIKVKRDDVNPVGYHDGEHTKNVKDWKEVFDIYFKDPMVIPSTTDPEDEGLRLVYNKWPQSPSDFREACEVYARHAEKLAFKLLELISLSLGLPKERFHDYFKEQMSFFRINRYPPCPRPDLALGVGHHKDADVISLLAQDDVGGLQVSRRSDGVWFPIRPVPNALVINIGNCMEIWTNDKYWSAEHRVVVNTTRERYSIPFFLLPSHDVEVKPLEELVSPENPPKYKGYKWGKFYVSRNRSDFRKLEIENIQIDDFKVKT

SEQ ID NO: 105 - DNA, 621 bp, Populus trichocarpa
  CDS (1)..(621): Gene (STT793), encoding a GTP-binding protein
atgccttcccgtagaagaactctcttgaaggttatcatcctcggcgacagcggggtaggaaagacctctttgatgaatcaatatgtaaataagaagtttagcaatcaatacaaggcgacaattggagcagattttttgactaaggaagttcagtttgaagataggctcttcactttacagatttgggatactgctgggcaggaaagattccaaagccttggtgttgctttctatcgtggtgctgattgttgtgtccttgtatatgatgtcaactcgatgaaatctttcgaccatcttaataattggagggaagaattcctcattcaggcaagtccttcagacccagagaatttcccatttgttgttcttggaaacaaggtcgatgtggatggtggaaatagcagagtggtttcagagaaaaaggcacgggcatggtgtgcttcgaaagggaatatcccttactttgagacctctgccaaggaaggtgttaatgttgaggaagctttccaatgcatagcaaagaatgccctgaagagtggagaagaggaagaaatatacttgccagacaccattgatgttggaagcagcagtcagcctaggtcaacgggatgcgagtgctaa

SEQ ID NO: 106 - protein, 206 aa, Populus trichocarpa
MPSRRRTLLKVIILGDSGVGKTSLMNQYVNKKFSNQYKATIGADFLTKEVQFEDRLFTLQIWDTAGQERFQSLGVAFYRGADCCVLVYDVNSMKSFDHLNNWREEFLIQASPSDPENFPFVVLGNKVDVDGGNSRVVSEKKARAWCASKGNIPYFETSAKEGVNVEEAFQCIAKNALKSGEEEEIYLPDTIDVGSSSQPRSTGCEC

SEQ ID NO: 107 - DNA, 621 bp, Populus trichocarpa
  CDS (1)..(621): Gene (Potri.009G115000), encoding a similar to RAS-related GTP-binding protein. [ORG:Pisum sativum]; [ co-ortholog (1of2) of At1g49300, At3g18820, S33531, AAQ72787, P31022, CAA98170, CAA46600
atgccttcccgtagaagaactctcttgaaggtcatcatcctcggagacagcggggtaggaaagacctctttgatgaatcaatatgtaaacaagaagtttagcaatcaatacaaggcgacaattggagctgatttcttgactaaggaagttcagtttgaagataggctcttcactttacagatctgggatactgctgggcaggaaagattccaaagcctcggtgttgctttctatcgtggtgctgattgttgtgttcttgtatatgatgtcaattcgatgaaatcttttgataaccttaataattggagggaagaattcctcattcaggcaagcccttcagacccagagaatttcccatttgttgttcttggaaacaaggtcgacgtggatggtggaaatagcagagtggtttcagagaaaaaggcacgggcatggtgtgcctcgaaagggaatatcccttactttgaaacctctgccaaggaaggcattaatgttgaggaagctttccaatgcatagcaaagaatgccctgaagagtggggaagaggaagagatatacttgccagataccattgatgttggaactagtagtcaacctaggtcaactggatgtgagtgctaa

SEQ ID NO: 108 - protein, 206 aa, Populus trichocarpa
MPSRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPENFPFVVLGNKVDVDGGNSRVVSEKKARAWCASKGNIPYFETSAKEGINVEEAFQCIAKNALKSGEEEEIYLPDTIDVGTSSQPRSTGCEC

SEQ ID NO: 109 - DNA, 624 bp, Populus trichocarpa
  CDS (1)..(624): Gene (Potri.003G053400), encoding a  Ras-related GTPase ortholog of O24461,At1g52280,AAB71504
atggcttctcgcagacgcatgctcttgaaggttataattctcggtgacagcggggtaggcaagacatcgctgatgaatcagtatgtgaatcgaaagttcagtaatcaatacaaggcaacaataggagctgactttttaaccaaagaagttcagtttgaggatagaatgttcacattacagatatgggatactgcaggacaagagaggtttcaaagtcttggagtggctttctatcgtggcgcggactgctgtgttcttgtgtatgatgtgaatgtcatgaagtcatttgacaatcttaacaattggagagaggagtttctgattcaggcaagtccatctgaccctgaaaacttcccatttgttgtgttggggaacaagatagatgttgatggaggcaatagtcgagtggtttctgagaagaaagcaaaggcatggtgtgctgctaagggaaacataccctactttgagacttctgcaaaagaaggtttcaatgtggatgctgcatttcagtgtatagcaaaaaatgcgcttaagaatgaacctgaagaagaaatataccttcctgacaccatcgatgttgggggtggggggcgacaacaaacatctaccggttgcgaatgttga

SEQ ID NO: 110 - protein, 207 aa, Populus trichocarpa
MASRRRMLLKVIILGDSGVGKTSLMNQYVNRKFSNQYKATIGADFLTKEVQFEDRMFTLQIWDTAGQERFQSLGVAFYRGADCCVLVYDVNVMKSFDNLNNWREEFLIQASPSDPENFPFVVLGNKIDVDGGNSRVVSEKKAKAWCAAKGNIPYFETSAKEGFNVDAAFQCIAKNALKNEPEEEIYLPDTIDVGGGGRQQTSTGCEC

SEQ ID NO: 111 - DNA, 624 bp, Populus trichocarpa
  CDS (1)..(624): Gene (Potri.001G182900), encoding a Ras-related GTP-binding family protein; [ ortholog of At3g16100
atggctactcgtagacgcatgctcttgaaggttataattctcggtgacagcggggtaggcaagacatcactaatgaatcagtatgtgaatcgaaagttcagtaatcaatacaaggcgacgataggagctgacttcttaaccaaagaagtccattttgaggatagattgttcacattgcagatatgggatactgcaggacaagagaggtttcaaagtcttggagtggctttctaccgtggtgcagactgttgtgttcttgtgcatgatgtgaatgtcatgaagtcatttgagaatcttaataattggcgagaagagtttctgattcaggctagcccatccgaccctgaaaacttcccatttgttgtgttggggaacaagatagatgttgatggaggcaatagtcgagtggtttctgagaagaaagcgaaggcatggtgcgctgctaagggaaacataccttactttgagacttccgcaaaagaaggcttcaatgtggacgctgcatttcagtgtatagcaaaaaatgcgcttaagaatgaacctgaagaagaaatataccttcctgacaccattgatgttgcgggtggagggcgacaacaaacgtccaccgggtgcgaatgttga

SEQ ID NO: 112 - protein, 207 aa, Populus trichocarpa
MATRRRMLLKVIILGDSGVGKTSLMNQYVNRKFSNQYKATIGADFLTKEVHFEDRLFTLQIWDTAGQERFQSLGVAFYRGADCCVLVHDVNVMKSFENLNNWREEFLIQASPSDPENFPFVVLGNKIDVDGGNSRVVSEKKAKAWCAAKGNIPYFETSAKEGFNVDAAFQCIAKNALKNEPEEEIYLPDTIDVAGGGRQQTSTGCEC

SEQ ID NO: 113 - DNA, 609 bp, Eucalyptus grandis
  CDS (1)..(609): Gene (Eucgr.G00442), encoding a Ras-related protein Rab-7A
atgccgtcccgccggagaacgctcctcaaggtcatcatcctcggggacagcggggtcgggaagacctctttgatgaaccaatatgtaaataaaaagttcagtaatcagtataaagcaactattggagctgatttcttgaccaaggaagttcagctcgacgataggctcttcactttacagatttgggatacagctggtcaagagagattccagagtcttggagtggctttctatcgaggtgctgactgctgtgttcttgtgtatgatgttaacgttatgaagtcatttgacaatcttaacaattggagggaggagttcctcatccaggcaagtccatcagatccagagaatttcccatttgtggtcataggaaacaaaatcgatgtggatggtggaaacagcagagtggtatcggagaaaaaagctcgagcttggtgtgcttcaaaggggaatataccatattttgagacctctgcgaaggaaggtgtcaacgtggaggaagcttttcaatgcatagctaagaatgccttgaaaagtggtgaagaagaagagatatacttgccagacaccatcgacgttgcaaacagcagtcagccaaggccatcatga

SEQ ID NO: 114 - protein, 202 aa, Eucalyptus grandis
MPSRRRTLLKVIILGDSGVGKTSLMNQYVNKKFSNQYKATIGADFLTKEVQLDDRLFTLQIWDTAGQERFQSLGVAFYRGADCCVLVYDVNVMKSFDNLNNWREEFLIQASPSDPENFPFVVIGNKIDVDGGNSRVVSEKKARAWCASKGNIPYFETSAKEGVNVEEAFQCIAKNALKSGEEEEIYLPDTIDVANSSQPRPS

SEQ ID NO: 115 - DNA, 624 bp, Eucalyptus grandis
  CDS (1)..(624): Gene (Eucgr.F03029), encoding a Ras-related GTPase
atggcatctcgcaggcgcatgctgctcaaggtcatcatcctcggcgacagcggggtcgggaagacgtctctcatgaaccagtacgtcaaccgcaagttcagtaaccagtacaaggcgaccattggagctgatttcttgacgaaggaagttcagtttgaagatcgattgttcacattgcagatatgggatactgctgggcaagaaaggttccagagtctgggtgtggctttttaccgaggtgcagactgctgcgtccttgtttatgatgtgaatgtcatgaaatcatttgataatcttaacaactggagggaagagtttctacttcaggccagcccatcagaccctgaaaactttccattcgtcgtgttggggaacaagatagatgttgatggtggtaatagtcgtgtggtttctgaaaagaaagcaaaggcttggtgtgcttctaagggaaacatcccttatttcgagacatctgcaaaagaaggattcaacgtggaggctgcatttgagtgtatagctaaaaatgctttgaagaatgaacctgaagaagaaatataccttcccgacaccattgacgtcactggtggtggacggcagcagagatctactggctgtgaatgttga

SEQ ID NO: 116 - protein, 207 aa, Eucalyptus grandis
MASRRRMLLKVIILGDSGVGKTSLMNQYVNRKFSNQYKATIGADFLTKEVQFEDRLFTLQIWDTAGQERFQSLGVAFYRGADCCVLVYDVNVMKSFDNLNNWREEFLLQASPSDPENFPFVVLGNKIDVDGGNSRVVSEKKAKAWCASKGNIPYFETSAKEGFNVEAAFECIAKNALKNEPEEEIYLPDTIDVTGGGRQQRSTGCEC

SEQ ID NO: 117 - DNA, 624 bp, Eucalyptus grandis
  CDS (1)..(624): Gene (Eucgr.J02962), encoding a Ras-related protein Rab-7A
atggcttctcgccggcgcatgctcctcaaggtcatcatcctcggcgacagcggggttgggaagacttctctgatgaatcagtacgtgaatcgcaagttcagcaatcagtataaggcgacgatcggagctgatttcttgacgaaggaagttcagtttgaggacaggctgttcacattgcagatatgggatacagctggccaagaaaggtttcaaagtcttggtgtggctttttacagaggtgccgactgctgtgttcttgtgtatgatgtgaatgtaatgaaatcattcgacaatctaaataactggcgggaggagtttttgattcaggccggtccttctgaccctgaaaacttcccatttgtcgttttgggtaacaaggtggatgtcgataatggcaatagtcgtgtggtttctgagaagaaagcgagggcttggtgtgcttccaaaggaaacattccttactttgagacctctgccaaagaaggatttaacgtggaagctgcttttgagtgtatagccaaaaatgctttgaagaatgaaccagaagaagaaatatatcttccggacaccattgatgttgcgggtggagcacggcagcagaggtccaccggctgcgagtgttga

SEQ ID NO: 118 - protein, 207 aa, Eucalyptus grandis
MASRRRMLLKVIILGDSGVGKTSLMNQYVNRKFSNQYKATIGADFLTKEVQFEDRLFTLQIWDTAGQERFQSLGVAFYRGADCCVLVYDVNVMKSFDNLNNWREEFLIQAGPSDPENFPFVVLGNKVDVDNGNSRVVSEKKARAWCASKGNIPYFETSAKEGFNVEAAFECIAKNALKNEPEEEIYLPDTIDVAGGARQQRSTGCEC

SEQ ID NO: 119 - DNA, 621 bp, Eucalyptus grandis
  CDS (1)..(621): Gene (Eucgr.C03821), encoding a Ras-related GTPase
atggcttctcggagacgcatgcttctcaaggtcataatccttggtgacagcggggttggaaagacatctttgatgaatcaatatgtgaaccgaaagttcagtaatcagtacaaagcaaccatcggggcagatttccttaccaaggaagtccagtttgaggatagacttttcacattgcagatatgggatacagcggggcaggaacggttccaaagtctcggagttgccttttaccgtggagctgactgttgtgttcttgtatatgatgtgaatgtgatgaaatcgtttgacaaccttaaccactggagagaggagtttctcattcaggccagcccttctgaccctgagaacttcccatttgttgtgttgggaaacaagattgacattgatggtggcaacagtcgagtggtatctgagaagaaagcgaaagcatggtgtgcctcaaagggaaacatttcttacttcgaaacttctgcaaaagaaggttttaatgttgaagcagctttccaatgtatagccaagaatgcccttaagaatgagcctgaagaagaactctaccttcccgatactatcgatgtggctggtggacagcagcagcgttcttcgggctgtgaatgttga

SEQ ID NO: 120 - protein, 206 aa, Eucalyptus grandis
MASRRRMLLKVIILGDSGVGKTSLMNQYVNRKFSNQYKATIGADFLTKEVQFEDRLFTLQIWDTAGQERFQSLGVAFYRGADCCVLVYDVNVMKSFDNLNHWREEFLIQASPSDPENFPFVVLGNKIDIDGGNSRVVSEKKAKAWCASKGNISYFETSAKEGFNVEAAFQCIAKNALKNEPEEELYLPDTIDVAGGQQQRSSGCEC

SEQ ID NO: 121 - DNA, 621 bp, Arabidopsis thaliana
  CDS (1)..(621): Gene (AT3G18820), encoding a RAB GTPase homolog G3F
atgccgtcccgtagacgtaccctcctcaaggtcatcatcctcggtgatagcggggtgggaaaaacctctttgatgaatcagtatgttaataaaaagttcagcaaccagtacaaggcaaccattggagccgacttcttgaccaaggaagtacagtttgaagatcgacttttcactttacagatctgggatacagctggacaggaaaggtttcagagccttggtgtagccttttaccgtggtgctgattgctgtgttcttgtatatgatgtcaattccatgaaatcatttgaaaatctgaacaactggagggaagaatttctgatccaggcgagtccatcagatccagagaattttccatttgttcttatcggaaacaaggttgacgtggatgatggaaacagcagagtggtttcagagaaaaaggctaaagcttggtgtgcttcaaaggggaacattccttactttgagacctctgccaaggtaggtactaatgtggaggaagctttccaatgcattgccaaggacgcattgaagagcggagaagaagaagaactatacttgccagacacaatcgatgtagggacgagcaatcaacagaggtctacagggtgtgaatgctaa

SEQ ID NO: 122 - protein, 206 aa, Arabidopsis thaliana
MPSRRRTLLKVIILGDSGVGKTSLMNQYVNKKFSNQYKATIGADFLTKEVQFEDRLFTLQIWDTAGQERFQSLGVAFYRGADCCVLVYDVNSMKSFENLNNWREEFLIQASPSDPENFPFVLIGNKVDVDDGNSRVVSEKKAKAWCASKGNIPYFETSAKVGTNVEEAFQCIAKDALKSGEEEELYLPDTIDVGTSNQQRSTGCEC

SEQ ID NO: 123 - DNA, 621 bp, Arabidopsis thaliana
  CDS (1)..(621): Gene (AT1G49300), encoding a RAB GTPase homolog G3F
atgccttctcgtagaagaactctcctcaaagtcatcatcctcggtgatagcggggttgggaagacttctttaatgaatcaatatgttaataagaagttcagcaaccagtataaggcaactattggggctgatttcttgactaaggaagttcaatttgaagaccggcttttcactttacagatctgggacacagctggtcaagaaaggtttcagagtcttggtgttgcgttttatcgtggtgctgattgctgtgttcttgtatatgatgtcaactccgcaaaatcattcgaggatctcaacaactggagggaagagtttctgatccaggcaagtccttcggatccagagaactttccctttgttgttatcggtaataagatcgatgtggatggtggaagcagccgggtggtatcagagaagaaggctcgagcttggtgtgcttcgaaaggaaacattccatactatgaaacctcagctaaagtaggcaccaatgtagaagacgcgttcctgtgcataactacgaacgcaatgaagagtggagaagaggaagaaatgtacctaccagacacgatcgatgtcggaaccagcaatccacagaggtcaacaggatgtgaatgctga

SEQ ID NO: 124 - protein, 206 aa, Arabidopsis thaliana
MPSRRRTLLKVIILGDSGVGKTSLMNQYVNKKFSNQYKATIGADFLTKEVQFEDRLFTLQIWDTAGQERFQSLGVAFYRGADCCVLVYDVNSAKSFEDLNNWREEFLIQASPSDPENFPFVVIGNKIDVDGGSSRVVSEKKARAWCASKGNIPYYETSAKVGTNVEDAFLCITTNAMKSGEEEEMYLPDTIDVGTSNPQRSTGCEC

SEQ ID NO: 125 - DNA, 621 bp, Arabidopsis thaliana
  CDS (1)..(621): Gene (AT3G16100), encoding a RAB GTPase homolog G3C
atggcttctcggcggcgagtgcttctgaaggttataattctcggagacagtggggttgggaagacgtccttgatgaatcagtttgtgaatcgaaaattcagtaatcagtataaagctaccattggagctgatttcttgaccaaagaggtccaaattgatgacagaatcttcactttgcagatttgggatactgcagggcaagagaggttccaaagtttgggtgttgctttctaccgaggagcggactgttgtgttcttgtgaatgatgtcaatgttatgaaatcctttgaaaatcttaacaactggagggaagagttcctgatccaggctagtccttcagatcctgaaaacttccccttcgttgtcttggggaacaagacagatgttgacggtggaaagagtcgagtggttactgagaagaaagcaaaatcttggtgtgcatccaagggaaacattccttacttcgagacttcggccaaagatggagtcaatgttgatgcagctttcgaatgcattgccaaaaatgctctcaagaatgaacctgaagaagaagtgtaccttccggacaccattgatgtagctggggctcggcaacaaagatcaactgggtgcgaatgctaa

SEQ ID NO: 126 - protein, 206 aa, Arabidopsis thaliana
MASRRRVLLKVIILGDSGVGKTSLMNQFVNRKFSNQYKATIGADFLTKEVQIDDRIFTLQIWDTAGQERFQSLGVAFYRGADCCVLVNDVNVMKSFENLNNWREEFLIQASPSDPENFPFVVLGNKTDVDGGKSRVVTEKKAKSWCASKGNIPYFETSAKDGVNVDAAFECIAKNALKNEPEEEVYLPDTIDVAGARQQRSTGCEC

SEQ ID NO: 127 - DNA, 2802 bp, Populus trichocarpa
  CDS (1)..(2802): Gene (STT795), encoding a calcium-binding protein with an EF-hand motif
atggcggtgccaaacatggatcaattcgaagcgtactttaagagagctgatttagatggggatggaagaatcagtggagctgaagctgtctctttctttcaaggatccaatttgcccaaacaagtccttgctcagatatggatgcatgctgatcagagtcgaactggcttccttggccggccggagttttttaatgctttaagacttgtaactgttgctcagagtaagcgagatttgacaccggacattgtcaaggcagcattatatggaccggctgcagcaaaaatccccccaccgcaaattaatcttcaagccacagctgctgcgcctcaaatggcggcggcttcacctatgggtgctgttgctccgacagcatctcaaggttttggctttagaggaccaggagttccaaatgctactatgaaccaacagtactttcctcggcatggtcaaactatgagaccacttcagggtgtccctccaggaactgcttcccgtccacctcaggtaatgcttactggaactgcttcccgacctcctcagggtatgccttccagtagtctggggggtccatcattcataatgcctactggaaccaccccccgtccacctcaattcatgtctggtggttctgctggtccaactcccagtgtctcaaacccgaacatatcaagtgattggcttggtggaaggactggtggagctccaactagccctggagggcccattgctaatgattctaaagttgtttctggaaatgggttcgcctctgattcgtttttcggtggtgatgtgttttctgcaacccctactgcaacaaaacaagaaccccctctgcctacttcttcagctaccagtccagttaagtccagctcacttgattcacttcagagtgcttttgctgtgcaacctctgggtggtcagcctgaacgaacccaatcattaccgagcccaggcccacaagtttcagcttcaaattctgcctcacttgtgtcacctggcatttcagttggagttggaaaatcttctgatagcacacagctttcatggccaaagatgaaaccaacagacattcagaagtataataaagtttttatggaagtagatactgacagagatggaagaatcactggtgagcaggcacggaatctttttttgagctggaggctaccaagagagattttaaagcaggtctgggatttatctgatcaggatagtgacagcatgctttctttgagggaattctgctttgccctttatttgatggagcggtacagggaaggccatcctcttccagcagctcttccaagtaatattatgtacgacgagaccttgttgtccatgacgggtcaacccaaagttgcttatggaagtgctgcttggggtcctggttttggacagcagcctacacgatccatggcccctgtccctggcatgaggccacctgttccagtaactgcctcccagcctgatggtgtcatggtaaacaatcaacacaagtcaggagctccaagtgatgaaacagagaagctgattttggactccaaagagaagattgagttttaccgttctaaaatgcaggatcttgttctgtatagaagcagatgtgataataggctaaatgaaatcacagaaagggctttggcagataaacgtgaggcagagttgctgggtaagaaatatgaagagaagtacaagcaagttgcagaagtggcatctaaattaacaattgaagaggcaacttttcgtgacattcaggagagaaagctggagttgcgtcaagcaataactaacatggaacaaggtggcagtgcggatggtattcttcaggttcgtgctgatcgtatacaatcagaccttgatgagctattgaaggttttaactgaacgctgcaagaaacatggactggatgttaagtcaactgccgtgattgagcttccttttggctggcaaccaggaattcaagagggtgctgctacttgggatgaagattgggataagtttgaagatgaagggttttccaatgagctcactgttgatgtgaaaagtgctcctggtcaaaaggagagagcacctgcggatggtagtttaacccctgattcattgtcaaatggagatgggaggtctggaatttttactggagaacatgtgcttgagagtgaatctgcatatttccacagtggagatgaaattgcaagaagccctcaaggcagtccagctggaagggctgcttcagaaagtccatctcaagactttgctgatgtttttgccaagaatactgaagcagatatagatacccatagaagttttgatgaatcaacttggggtgcctttgacacaaatgatgatgtggactcagtctggggatttaaccctgcaggcaacaaggactcttctgagaacgagagagatttctttggatctgatgattttggtctaaagccaatcagaacggaatccacaccaacaacgaatactttccagaaaaagagtatattttttgaagaatctgttgcaggttccccaatgtcaagatttggcaactctccaaggttcagcgaagcaggggaccattttgacaattactcgagatttgattccttcagcatgaatgaaggaggcttttcaccacgagaaaagcttacaaggttcgactccataaacagttccaaagattttggccacagtcgtgcattctcttcatttgatgatggagatccatttggctccagcgccccctttaaggtttcatctgaagatcaaactcccaaaaagagttctggcaattggagttctttctag

SEQ ID NO: 128 - protein, 933 aa, Populus trichocarpa
MAVPNMDQFEAYFKRADLDGDGRISGAEAVSFFQGSNLPKQVLAQIWMHADQSRTGFLGRPEFFNALRLVTVAQSKRDLTPDIVKAALYGPAAAKIPPPQINLQATAAAPQMAAASPMGAVAPTASQGFGFRGPGVPNATMNQQYFPRHGQTMRPLQGVPPGTASRPPQVMLTGTASRPPQGMPSSSLGGPSFIMPTGTTPRPPQFMSGGSAGPTPSVSNPNISSDWLGGRTGGAPTSPGGPIANDSKVVSGNGFASDSFFGGDVFSATPTATKQEPPLPTSSATSPVKSSSLDSLQSAFAVQPLGGQPERTQSLPSPGPQVSASNSASLVSPGISVGVGKSSDSTQLSWPKMKPTDIQKYNKVFMEVDTDRDGRITGEQARNLFLSWRLPREILKQVWDLSDQDSDSMLSLREFCFALYLMERYREGHPLPAALPSNIMYDETLLSMTGQPKVAYGSAAWGPGFGQQPTRSMAPVPGMRPPVPVTASQPDGVMVNNQHKSGAPSDETEKLILDSKEKIEFYRSKMQDLVLYRSRCDNRLNEITERALADKREAELLGKKYEEKYKQVAEVASKLTIEEATFRDIQERKLELRQAITNMEQGGSADGILQVRADRIQSDLDELLKVLTERCKKHGLDVKSTAVIELPFGWQPGIQEGAATWDEDWDKFEDEGFSNELTVDVKSAPGQKERAPADGSLTPDSLSNGDGRSGIFTGEHVLESESAYFHSGDEIARSPQGSPAGRAASESPSQDFADVFAKNTEADIDTHRSFDESTWGAFDTNDDVDSVWGFNPAGNKDSSENERDFFGSDDFGLKPIRTESTPTTNTFQKKSIFFEESVAGSPMSRFGNSPRFSEAGDHFDNYSRFDSFSMNEGGFSPREKLTRFDSINSSKDFGHSRAFSSFDDGDPFGSSAPFKVSSEDQTPKKSSGNWSSF

SEQ ID NO: 129 - DNA, 3213 bp, Populus trichocarpa
  CDS (1)..(3213): Gene (Potri.T102700), encoding a Synaptic vesicle protein EHS-1 and related EH domain proteins
atggcggtgccaaacatggatcaattcgaagcgtactttaagagagctgatttagatggggatggaagaatcagtggagctgaagctgtctctttctttcaaggatccaatttgcccaaacaagtccttgctcagatatggatgcatgctgatcagagtcgaactggcttccttggccggccggagttttttaatgctttaagacttgtaactgttgctcagagtaagcgagatttgacaccggacattgtcaaggcagcattatatggaccggctgcagcaaaaatccccccaccgcaaattaatcttcaagccacagctgctgcgcctcaaatggcggcggcttcacctgtgccgcagatgggttctgctgccccaacaacatctcaaggttttggttttagaggaccaggagttccaacggctgcgcctcaaatggttgcttcatctgccacgcagatgggtgctgttgctccgacagcatctcaaggttttggctttagaggaccaggagttccaaatgctactatgaaccaacagtactttcctcggcatggtcaaactatgagaccacttcagggtgtccctccaggaactgcttcccgtccacctcagggtatgcctgccattagtctggggggtccatcgtcagtaatgcttactggaactgcttcccgacctcctcagggtatgccttccagtagtctggggggtccatcattcataatgcctactggaaccaccccccgtccacctcaattcatgtctggtggttctgctggtccaactcccagtgtctcaaacccgaacatatcaagtgattggcttggtggaaggactggtggagctccaactagccctggaggggtccagccatctattcccaccactacttcccagccgcgacctctaagctcagtttcctctcagcccattgctaatgattctaaagttgtttctggaaatgggttcgcctctgattcgtttttcggtggtgatgtgttttctgcaacccctactgcaacaaaacaagaaccccctctgcctacttcttcagctaccagtggcacacaagctcccattaagtccggctcacttgattcactgttgaaagctgttaacaacccaacctcatcttccattgtctcgggttctagtgatgcccaagcccgaggtccagttaagtccagctcacttgattcacttcagagtgcttttgctgtgcaacctctgggtggtcagcctgaacgaacccaatcattagcgagcccaggcccacaagtttcagcttcaaattctgcctcacttgtgtcacctggcatttcagttggagttggaaaatcttctgatagcacacagctttcatggccaaagatgaaaccaacagacattcagaagtataataaagtttttatggaagtagatactgacagagatggaagaatcactggtgagcaggcacggaatctttttttgagctggaggctaccaagagagattttaaagcaggtctgggatttatctgatcaggatagtgacagcatgctttctttgagggaattctgctttgccctttatttgatggagcggtacagggaaggccatcctcttccagcagctcttccaagtaatattatgtacgacgagaccttgttgtccatgacgggtcaacccaaagttgcttatggaagtgctgcttggggtcctggttttggacagcagcctacacgatccatggcccctgtccctggcatgaggccacctgttccagtaactgcctcccagcctgatggtgtcatggtaaacaatcaacacaagtcaggagctccagtgttggaggattcctttttgaaccaacatgatggcggagagcagagttcagcaaactcaatgattcaagatggaacagcctcagagaaaaagagtgatgaaacagagaagctgattttggactccaaagagaagattgagttttaccgttctaaaatgcaggatcttgttctgtataaaagcagatgtgataataggctaaatgaaatcacagaaagggctttggcagataaacgtgaggcagagttgctgggtaagaaatatgaagagaagtacaagcaagttgcagaagtggcatctaaattaacaattgaagaggcaacttttcgtgacattcaggagagaaagctggagttgcgtcaagcaataactaacatggaacaaggtggcagtgcggatggtattcttcaggttcgtgctgatcgtatacaatcagaccttgatgagctattgaaggttttaactgaacgctgcaagaaacatggactggatgttaagtcaactgccgtgattgagcttccttttggctggcaaccaggaattcaagagggtgctgctacttgggatgaagattgggataagtttgaagatgaagggttttccaatgagctcactgttgatgtgaaaagtgctcctggtcaaaaggagagagcacctgcggatggtagtttaacccctgattcattgtcaaatggagatgggaggtctggaatttttactggagaacatgtgcttgagagtgaatctgcatatttccacagtggagatgaaattgcaagaagccctcaaggcagtccagctggaagggctgcttcagaaagtccatctcaagactttgctgatgtttttgccaagaatactgaagcagatatagatacccatagaagttttgatgaatcaacttggggtgcctttgacacaaatgatgatgtggactcagtctggggatttaaccctgcaggcaacaaggactcttctgagaacgagagagatttctttggatctgatgattttggtctaaagccaatcagaacggaatccacaccaacaacgaatactttccagaaaaagagtatattttttgaagaatctgttgcaggttctccaatgtcaagatttggcaactctccaaggttcagcgaagcaggggaccattttgacaattactcgagatttgattctttcagcatgaatgaaggaggcttttcaccacgagaaaagcttacaaggttcgactccataaacagttccaaagattttggccacagtcgtgcattctcttcatttgatgatggagatccatttggctccagtgccccctttaaggtttcatctgaagatcaaactcccaaaaagagttctggcaattggagttctttctag

SEQ ID NO: 130 - protein, 1070 aa, Populus trichocarpa
MAVPNMDQFEAYFKRADLDGDGRISGAEAVSFFQGSNLPKQVLAQIWMHADQSRTGFLGRPEFFNALRLVTVAQSKRDLTPDIVKAALYGPAAAKIPPPQINLQATAAAPQMAAASPVPQMGSAAPTTSQGFGFRGPGVPTAAPQMVASSATQMGAVAPTASQGFGFRGPGVPNATMNQQYFPRHGQTMRPLQGVPPGTASRPPQGMPAISLGGPSSVMLTGTASRPPQGMPSSSLGGPSFIMPTGTTPRPPQFMSGGSAGPTPSVSNPNISSDWLGGRTGGAPTSPGGVQPSIPTTTSQPRPLSSVSSQPIANDSKVVSGNGFASDSFFGGDVFSATPTATKQEPPLPTSSATSGTQAPIKSGSLDSLLKAVNNPTSSSIVSGSSDAQARGPVKSSSLDSLQSAFAVQPLGGQPERTQSLASPGPQVSASNSASLVSPGISVGVGKSSDSTQLSWPKMKPTDIQKYNKVFMEVDTDRDGRITGEQARNLFLSWRLPREILKQVWDLSDQDSDSMLSLREFCFALYLMERYREGHPLPAALPSNIMYDETLLSMTGQPKVAYGSAAWGPGFGQQPTRSMAPVPGMRPPVPVTASQPDGVMVNNQHKSGAPVLEDSFLNQHDGGEQSSANSMIQDGTASEKKSDETEKLILDSKEKIEFYRSKMQDLVLYKSRCDNRLNEITERALADKREAELLGKKYEEKYKQVAEVASKLTIEEATFRDIQERKLELRQAITNMEQGGSADGILQVRADRIQSDLDELLKVLTERCKKHGLDVKSTAVIELPFGWQPGIQEGAATWDEDWDKFEDEGFSNELTVDVKSAPGQKERAPADGSLTPDSLSNGDGRSGIFTGEHVLESESAYFHSGDEIARSPQGSPAGRAASESPSQDFADVFAKNTEADIDTHRSFDESTWGAFDTNDDVDSVWGFNPAGNKDSSENERDFFGSDDFGLKPIRTESTPTTNTFQKKSIFFEESVAGSPMSRFGNSPRFSEAGDHFDNYSRFDSFSMNEGGFSPREKLTRFDSINSSKDFGHSRAFSSFDDGDPFGSSAPFKVSSEDQTPKKSSGNWSSF

SEQ ID NO: 131 - DNA, 2895 bp, Populus trichocarpa
  CDS (1)..(2895): Gene (Potri.005G253000), encoding a  Synaptic vesicle protein EHS-1 and related EH domain proteins
atggcgctgccaaacatggatgtattcgaagcttacttcaagagagctgatttagatggagatggaagaattagtggagctgaaggtttttctttctttcaaggatccaatttgcccaaacaagtccttgctcagatatggatgcatgctgatcagagtcgcagtggcttccttggccggccggaattttttaatgctcttagacttgtaactgttgcacagagtaagcgagatttgacaccggatattgtcaaggcggcattatatgggctagctgcagctaaaatcccaccaccgcaaattaatcttcatgccacagcggggcctcaaatggctgcggcttcaactgccctgcagatgggtgctggtaccccaacagcatctcaaggttttggctttagaggaccaggagttcaaacggctgtgcctcaaatggttgcttcttctggcccacagatgagtgctgttgccccaacagcgtctcaaggttttggctttagaggaccaggagttcaaacggctgtgcctcaaatggttgcttcatctgccccacagatgggtgcttttgctccgacagcgttgcaaagtcctggatttagaggaccaggagttccaaatgctagtatgaacccacaatactttccacagcaaagtcagacaatgagaccacttcagggtgtccctgctggaactgcttcccgtccacctcagggtatgctttccagtaatcttgggggtccatcatcagtaatgcctactggaactgcttctcgtccacctcaattcatgtctggtggtactgttggctccactcccagtgtatcaaacccgaacatctcaaatgattggcttggtggaaggactagtggagctccacctggccctggaggtgtccggccatctacattgaccactactcagccacgacctctaagcacggtttcctcccagcccactgctaatgattctaaagtcccggttgtttctggaaatgggtttgcctctaatttgttttttggtagtgatgtattttctgcaaccgctgctgcaacaaaacaggaaccctctctgctgtctgctactggtggtgcacaacctccgcggacccaatcattactgagctccggcccacatgtttcagcttcaagttctgcctcaattgtgtcacctggcatttcagctggagctggaaattcttctgataactcacagctttcatggccaaagatgaaaccagcagacattcaaaattatactaaagtttttatggaagtagatactgacagagatggaagaatcactggtgagcaggcacggaatctttttctgagctggaggttaccaagagagattttaaagcaggtctgggatttatctgatcaagatagtgatagcatgctttctttgagggaattctgctttgccctttatttgatggagaggtacagggaaggccgtcctcttccagcagctcttccaaataatgttttgtatgatgagaccttgttgtcaatgacaggtcaacccaaagttgcttatggaaatgctgcgtggggtcccagtcctggttttgcacagcagctggggatgggtgcccgacctatggctcctatccttggtatgaggacaccagttccagtaaatgccccccagcctgatgctgcaatggccaacaatcagcagatgtcaggagtgccagtcttggaggattcctttttgaaccaacatgaaggtggagagcagaattcagcaaactcaatgactcaagatggaacagcctcagagaaaaagattgatgaagcagagaagctgattttggacttcaaggagaagattgagttttaccgttctaaaatgcaggatcttgttctatataaaagcagatgtgataataggctaaatgaaatcacagaaagggctttggctgatacacgagaggcagagttgctgggtaagaaatacgaagagaagtacaagcaagttgcagaagtggcatctaaattaacaattgaagaggcaacatttcgtgacattcaggagagaaagctggagttgcatcaaggaataactaacatggaacaaggtggcagtgcagatggtattcttcaggttcgtgctgatcgtatacaatcagaccttgatgagctattaaaggctttaactcaacgctgcaagaaacatgaactcactgttaagtcaactgcagtgattgagcttcctttcggctggcaaccaggaattcaagaggatgctgctacttgggatgaagattgggacaagtttgaagatgaagggttttccaacgagctcactgttgatgtgaaaagtgctcctggtcaaaaggagagagcatctgtagatgatagtttaacccctgattcattatcaaatggtgatgggaggtcagggattttcaccggcaaacatgtacttgagagtgaagctgcttataaccacagtgaagatgaaatggcaagaagccctcaaggcagtccagctggaaggtctgcgtcagaaagtccatctcaagacttttctgatgtttttgccaagagtactgaagcagatatagatacacatagaagtttcgatgaatcaatttggggtgcttttgacacaaatgatgatgtggactcagtctggggatttaaccctacaggcaacaaggcatcgtcggagaatgagggaggtttctttggatctgatgattttggtctaaagcctataagaacgggatccacatcccctgcaaatactattcagaaaaatagtatattttttgaagaatctgttgcaggctccccaatgtcaagatttagcaactctccaaggtacagtgaagcaggggatcattttgacaattacttgagatttgattcctttccttcagcatga

SEQ ID NO: 132 - protein, 964 aa, Populus trichocarpa
MALPNMDVFEAYFKRADLDGDGRISGAEGFSFFQGSNLPKQVLAQIWMHADQSRSGFLGRPEFFNALRLVTVAQSKRDLTPDIVKAALYGLAAAKIPPPQINLHATAGPQMAAASTALQMGAGTPTASQGFGFRGPGVQTAVPQMVASSGPQMSAVAPTASQGFGFRGPGVQTAVPQMVASSAPQMGAFAPTALQSPGFRGPGVPNASMNPQYFPQQSQTMRPLQGVPAGTASRPPQGMLSSNLGGPSSVMPTGTASRPPQFMSGGTVGSTPSVSNPNISNDWLGGRTSGAPPGPGGVRPSTLTTTQPRPLSTVSSQPTANDSKVPVVSGNGFASNLFFGSDVFSATAAATKQEPSLLSATGGAQPPRTQSLLSSGPHVSASSSASIVSPGISAGAGNSSDNSQLSWPKMKPADIQNYTKVFMEVDTDRDGRITGEQARNLFLSWRLPREILKQVWDLSDQDSDSMLSLREFCFALYLMERYREGRPLPAALPNNVLYDETLLSMTGQPKVAYGNAAWGPSPGFAQQLGMGARPMAPILGMRTPVPVNAPQPDAAMANNQQMSGVPVLEDSFLNQHEGGEQNSANSMTQDGTASEKKIDEAEKLILDFKEKIEFYRSKMQDLVLYKSRCDNRLNEITERALADTREAELLGKKYEEKYKQVAEVASKLTIEEATFRDIQERKLELHQGITNMEQGGSADGILQVRADRIQSDLDELLKALTQRCKKHELTVKSTAVIELPFGWQPGIQEDAATWDEDWDKFEDEGFSNELTVDVKSAPGQKERASVDDSLTPDSLSNGDGRSGIFTGKHVLESEAAYNHSEDEMARSPQGSPAGRSASESPSQDFSDVFAKSTEADIDTHRSFDESIWGAFDTNDDVDSVWGFNPTGNKASSENEGGFFGSDDFGLKPIRTGSTSPANTIQKNSIFFEESVAGSPMSRFSNSPRYSEAGDHFDNYLRFDSFPSA

SEQ ID NO: 133 - DNA, 2943 bp, Eucalyptus grandis
  CDS (1)..(2943): Gene (Eucgr.F01786), encoding a Synaptic vesicle protein EHS-1 and related EH domain proteins
atggcggcgcagggccaaggggcgggcgcggagcagttcgaggcgtacttcaggagggcggatttggacggggacggcaggatcagcggggccgaggccgtcgccttcttccaaggatccggcttgccgaagcacgtccttgctcagatatggatgcatgctgatcaggctcgtactggtttccttggtcgggcagaattttacaatgctctgaagcttgtcacagtagcacagagtaaaagggaattatcagcagatatagtcaaggccgccttatatggccccgctgctgctaaaataccccctccacaaattaatcttgcttctgtacctgcaccacatgtgagaaatgcacctgttgcggcaaccccgcagatgagagcagcagctcaaccaacatctcagagtgttggctttggatttccttcacaacaacaacaaccaccacctgtgagaccgcctcaacctatgcctgctcctactgctttccgtgcaccacaggcaaatacaggttcacaattttccatggggagtagtttaacaggtgctggggttccaaacgcaaacatttcaagtgattggaccggaggaatgagtggcggagcatcagttggacccagagatactaattcttcggttctgtcagctttatcaaagccacaaattccaccttctttatcttcacagacaatggccgttgattctaaagcactagttgtttctggaaatggatcttcttcagatacttttcttggaggtgatttattttctgcaaaaccctctccatctaaacaagaatcttctgcactaagtaatccagctgccggcacatctctcgcctctgctatgacttctgttcctggaagccaaccttctgtaaagcccaatgcactggatgctttgcagacttcattctctgtgctttcttctagcagtcaggttcagcgtcctcctacaccttcgaacccacgagcgcagggtccatctctaggtttttcctcattctcatcgcctggaatttcagttggggtagctaattcttctcccagtgatagtcagcttaattggccaaagatgaagccatctgatgttcaaaaatacacgaaggtttttatggaagtggacacagatagagatgggaaaattactggcgagcaggctcgcaacttatttctgagttggaggctaccaagagaggtcttaaagcaggtgtgggacttgtctgatcaggatagtgacagcatgctctctttgagggagttttgctttgccctatatttgatggagcgacatagggagggtcgtcctcttcccacagctcttcctagtaatgtcatgtacgatgaaacactattgtcaatgacaggtttaccaaatgttgcttatggaaatgccgcttggggtgccaattcgggttttaggccacagcaaggaatgccaggtgctcgaccattggctcctgcaactggcttgaggccaggaatgcaggttcccattcctaaggcagatgctgcgaagcaaaccaatcaacaagacttgagaggaccagctttaggggacccatttgcaaacataggtggcaacactgaaccaaattcagttggttcagcacctcaagacgcaacaactggggggcaaaaggtggaagaaaaggagaaagttatattggattcaaaggagaagattgagttttaccgcacaaaaatgcaagaccttgttttatttaaaagcagatgtgataataaattgaatgagatgacggagagggcatctgcagataagcgtgaggccgagtttcttggcaaaaagtatgaagagaagtacaagcaagtcgcagaaatagcatctaagttaaccattgaggaggcgacctttcgtgatcttcaggaaaggaaaatggagttgcataaggccattgtcacagtggaacaaggtggcagtgcagatggccttcttcaggtccgagctgatcgcatccaatcagatgttgatgagcttatgaaggctttgacagaacgttgcaagaagcatagtctagatgtcaaatcaactgcactatttgagcttccgaatggctggcagcctgggattcaggagggagctgccgtttgggatgaagattgggacaagtttgaagatgaaggctttgtcaatggcctgaatctggatgggaaaaatgtctctgttgagagagagaatgcttctactgagaatggttatgcccatgattctatctcaagtccaggtgaaaagcatcagaactctttgggtaccatggaaaatgcttttgagaatgaatatcaatatgcccatagtgaagatgattcagcacgaagccctcatgaaagtccggttggtagaacttctgtagggagtccatcccaagtattttcaggtgcacattttgaaaagagtcctgaagcagatattgatacacatggaagttttgatgaatcaacctggggtgccttcgacaataatgatgatgtggactccgtctggggatttggtaccaaggactcgaagcatggtgattattcctttacaacgagtgactttggagcaaacccaatacgaacaggctccccacgagaagataatgctttccaaagcaggagtggtttcgctttcgatgattctgtcccagccactcctctatctagatttggcaactcctcgccgagatacagcgaagcaggggatcactcctttgacaacttctcgaggttcgattccttcagaacccacgacagcggattttatccccaacaacctgagaggcttactaggtttgactccatcaatagcaccaaggacttcggccacagtcgtggattctcttcttttgatgattcagacccatttggttcgtccggtccatttaaggtttcttcggagagccacactccaaagaaaagttcagataactggaacgccttctag

SEQ ID NO: 134 - protein, 980 aa, Eucalyptus grandis
MAAQGQGAGAEQFEAYFRRADLDGDGRISGAEAVAFFQGSGLPKHVLAQIWMHADQARTGFLGRAEFYNALKLVTVAQSKRELSADIVKAALYGPAAAKIPPPQINLASVPAPHVRNAPVAATPQMRAAAQPTSQSVGFGFPSQQQQPPPVRPPQPMPAPTAFRAPQANTGSQFSMGSSLTGAGVPNANISSDWTGGMSGGASVGPRDTNSSVLSALSKPQIPPSLSSQTMAVDSKALVVSGNGSSSDTFLGGDLFSAKPSPSKQESSALSNPAAGTSLASAMTSVPGSQPSVKPNALDALQTSFSVLSSSSQVQRPPTPSNPRAQGPSLGFSSFSSPGISVGVANSSPSDSQLNWPKMKPSDVQKYTKVFMEVDTDRDGKITGEQARNLFLSWRLPREVLKQVWDLSDQDSDSMLSLREFCFALYLMERHREGRPLPTALPSNVMYDETLLSMTGLPNVAYGNAAWGANSGFRPQQGMPGARPLAPATGLRPGMQVPIPKADAAKQTNQQDLRGPALGDPFANIGGNTEPNSVGSAPQDATTGGQKVEEKEKVILDSKEKIEFYRTKMQDLVLFKSRCDNKLNEMTERASADKREAEFLGKKYEEKYKQVAEIASKLTIEEATFRDLQERKMELHKAIVTVEQGGSADGLLQVRADRIQSDVDELMKALTERCKKHSLDVKSTALFELPNGWQPGIQEGAAVWDEDWDKFEDEGFVNGLNLDGKNVSVERENASTENGYAHDSISSPGEKHQNSLGTMENAFENEYQYAHSEDDSARSPHESPVGRTSVGSPSQVFSGAHFEKSPEADIDTHGSFDESTWGAFDNNDDVDSVWGFGTKDSKHGDYSFTTSDFGANPIRTGSPREDNAFQSRSGFAFDDSVPATPLSRFGNSSPRYSEAGDHSFDNFSRFDSFRTHDSGFYPQQPERLTRFDSINSTKDFGHSRGFSSFDDSDPFGSSGPFKVSSESHTPKKSSDNWNAF

SEQ ID NO: 135 - DNA, 3060 bp, Arabidopsis thaliana
  CDS (1)..(3060): Gene (AT1G20760), encoding a Calcium-binding EF hand family protein
atggcgggtcagaatcctaacatggatcaattcgaggcctacttcaaaagagcagatttagacggagatggtcggatcagtggtgccgaagctgttggattttttcaaggatctggtttgtctaagcaggttctcgcccagatatggtcgctttctgatcggtcacacagtggtttccttgatcggcaaaacttttataattctctgagacttgtaacagttgcacagagcaagagagatctgacacctgagattgttaatgcagcactgaatactcctgcagcagccaaaataccacctcccaaaattaatctttcagctatccctgcaccccgacctaatcctgctgctacaacggtcggtccagtttccgggtttggaggaccaggggctccaaatgcgattgtcaatcagaattattttccacctcagcaaaaccagcaaatgagaccaaatcaaggaatatctgggctgacttcacttagaccagcggctggtccagaatatagaccaagtgccttatcaggtcaattccaaccagttcctgttggtagtgttacgcatcctcctcagcctgttcccactagtgtatctggtcctggtagttcaacgttcaatcttaatagtttgtatgctggagctggaaacaccagcggatattcgtcaggctttggagggggcagcttagcagcaccttctcctggcttaaaacaagagtcacacattgatccaaaggcgcttgttgtatctggaaatggaggtgacatgttttcctctttccagcaaaaacaagaacccactctgagtaattcttcaattagttcagccattgtccctacttctgctggaatccaacctccaacaaagcctaatgctctcgattccctacagagtactttctcaatgctaccttcaggaaatcagcttcagcagccaaggccagcagcaagctcacagcctgcagtgtcctcacaaggtccatcctccggtttgccacctggaagtgcagttggatctggccattctactcctgctggaaataatcagcctccgtggccaaaaatgaaaccatccgatgttcagaaatacacaaaggtatttatggaagttgatagtgacaaggatggaaaaatcactggtgagcaggcgaggaatctatttttaagctggaggttacccagggaggtattgaagcatgtgtgggaattatctgatcaggataatgatactatgctttctctgagggagttctgcatttcattgtatttgatggagcggtatagagaaggccgtcctctcccgaccgcacttcctagcagcatcatgtttgatgaaacactgctatctatctcaggcgcacccagtcatggctatgcaaatgctggatggggatctggtcaaggttttgtacagcaaccagggatgggtgcgcggccaatcactccaacgactggtatgagaccaccagttcctgcaccaggccctcaacctggcagtggtataccacctaatcagccaaggaatcaagcgccagttttggatgctccttttgctaatcacctaggtaatggatattctgcaagctcaaatcttccagaagcagcagctgatgaggaaaaggttgatgaaaagcagaatgcctatatggactccagggagaaacttgattactaccggacgaaaatgcaggatattgtcttgtacaaaagcaggtgtgacaatagattaaatgagatctccgaaagggcttctgctgacaagcgtgaggctgaaacattggcaaagaagtatgaggagaagtataagcaagttgcagaaatagggtcaaaattaactattgaagaggccaggttccgtgagattgaggggcggaagatggagttgagtcaagcaattgtgaacatggagcaaggtggtagtgctgatggtctccttcaggtccgggctgacagaatacaatcagatcttgaggaattgatgaaggctttaactgaacgatgcaagaaacacgggttggaggttaactcgaaggcccttgtagaccttccagctggctggcaacctggaattcaagaaggtgcagctctttgggatgaggaatgggataagtttgaagatgaaggttttggcaatgagatcacttttgacaaatcaaaagagcaaaactcgtctggtgagaaggaaaatggtacggtggatgatggtagtgggccacctgattcgccgacccatgtagaggacaactatggccctttttcagaaacctcagaccgccaccatgagagtgaatatgggacaactcacagtgaagatagaagtcctagagacagtcctgtctctaggaatgctactgaggtcccatctccagattattctcagggaaagaattctgaattctttgatgactcgaattgggcaagtgcatttgacactaacgatgatgtggattcagtctggggatttgatgcatcaaaaagccaggatggagattactttggatcaggtgacgattttggtggaaacacagcaagagcagattctccaagttcaagaagctttggcgcccagagaaagagccaatttgcatttgatgattcagtccccagcactccactctcaagattcgggaactctccacctcggttcagcgatgcatcagctagagataataactttgatagcttctccaggttcgactccttcaacaccagtgaagcaggcgccgggttttcttcgcagcccgagagactgtctcggtttgattccatcaacagctccaaagactttggtggagctgccttctctaggttcgattcaattaacagttccagagacgtcactggagctgagaaattttcgaggtttgattccatcaacagtagcaaagactttggtggtccctcgctatcaagattcgactctatgaatagtacaaaggatttcagtggtagccatggatactcgtttgatgatgcagacccgtttggttccacaggtccctttaaagtctcttcggatgaaagccctacgaaaaggtcagataactggaactccttctag

SEQ ID NO: 136 - protein, 1019 aa, Arabidopsis thaliana
MAGQNPNMDQFEAYFKRADLDGDGRISGAEAVGFFQGSGLSKQVLAQIWSLSDRSHSGFLDRQNFYNSLRLVTVAQSKRDLTPEIVNAALNTPAAAKIPPPKINLSAIPAPRPNPAATTVGPVSGFGGPGAPNAIVNQNYFPPQQNQQMRPNQGISGLTSLRPAAGPEYRPSALSGQFQPVPVGSVTHPPQPVPTSVSGPGSSTFNLNSLYAGAGNTSGYSSGFGGGSLAAPSPGLKQESHIDPKALVVSGNGGDMFSSFQQKQEPTLSNSSISSAIVPTSAGIQPPTKPNALDSLQSTFSMLPSGNQLQQPRPAASSQPAVSSQGPSSGLPPGSAVGSGHSTPAGNNQPPWPKMKPSDVQKYTKVFMEVDSDKDGKITGEQARNLFLSWRLPREVLKHVWELSDQDNDTMLSLREFCISLYLMERYREGRPLPTALPSSIMFDETLLSISGAPSHGYANAGWGSGQGFVQQPGMGARPITPTTGMRPPVPAPGPQPGSGIPPNQPRNQAPVLDAPFANHLGNGYSASSNLPEAAADEEKVDEKQNAYMDSREKLDYYRTKMQDIVLYKSRCDNRLNEISERASADKREAETLAKKYEEKYKQVAEIGSKLTIEEARFREIEGRKMELSQAIVNMEQGGSADGLLQVRADRIQSDLEELMKALTERCKKHGLEVNSKALVDLPAGWQPGIQEGAALWDEEWDKFEDEGFGNEITFDKSKEQNSSGEKENGTVDDGSGPPDSPTHVEDNYGPFSETSDRHHESEYGTTHSEDRSPRDSPVSRNATEVPSPDYSQGKNSEFFDDSNWASAFDTNDDVDSVWGFDASKSQDGDYFGSGDDFGGNTARADSPSSRSFGAQRKSQFAFDDSVPSTPLSRFGNSPPRFSDASARDNNFDSFSRFDSFNTSEAGAGFSSQPERLSRFDSINSSKDFGGAAFSRFDSINSSRDVTGAEKFSRFDSINSSKDFGGPSLSRFDSMNSTKDFSGSHGYSFDDADPFGSTGPFKVSSDESPTKRSDNWNSF

SEQ ID NO: 137 - DNA, 3744 bp, Arabidopsis thaliana
  CDS (1)..(3744): Gene (AT1G21630), encoding a Calcium-binding EF hand family protein
atggcagcgccaaggccgactggaggccaggatctgttcgatacgtatttcaggagagcagatttggatggagatggtcatattagtggagctgaggctgtcgctttcttccagggatcgaatttgcctaaacatgtccttgctcaggtatggtcctatgcagattcaaaaaaagccggctaccttggccgagcggagttttataatgctctaaagttggtaacagtggcacaaagtagacgagagttgactgctgagatagtaaaagctgcaatttatagtcctgcttcagccaatatccctgcacccaaaataaatcttgctgcaacaccttctccacagcccagaggagttttgcctgctacacaagctcagggagttacatcaatgccatcagtagcggctggtgtgagagggcctcacatgggtggaactgtaagcactagtaaccaacaagtagtcccaggccaacagaaccagtttactgggatacctccatctcagacacagcaaaactttcaaagcccgggaatgccagctggagggactaatgcacctcgtcctgcaaaccaacctatgccatctgattggctcagcggcagaagtgttggtccctctgggaacgtgaattctcaaattccttcgagtcagagtacatatggtttgacagcacctaattcaactgccaaccatataacaaaaccacatataacacctgcagtaacaagctctacaacaaccagaccccaagagtcagcgcctgtgcacaatccccaagaatcatctgctactttcggttctcgtgtatcaaatgttccatccaatcaattggtgcccaaggatcccaaggaactggctgcatcaggaaacgggtttacctctgactcacttttcggagatgtcttttcagttacttccacgcagccaaaacaacatcctacgggaagtgcatcaacaacaggcatctcatcggttactactggaactgtcgcgggccctgagatcacacagtctgtagttaggcaaagttcaatcccacaacagggttcattgagccagcatgctgttggtgttcagacccagcttactggaaactcagggcaaccatatacttcctcaggtgcggcttctggtccacctggctctactgttggagttggaatttcagctaccagtcagttggcccagcgtccgccccacccccactctcaaccacaaccccggccccagggccagtcccaacctccttggccaaaaatgactccagctgatgtccagaaatataccaaggtttttgtgcaagttgacactgatagggacggaaagatcacagggaaccaggctcggaatttgttcttaagttggaggcttccaagagacgctttgaagcaggtatgggatttatctgatcaagataatgacagcatgctctccttgcgggagttctgtattgcggtctatcttatggagcgttacagagagggccgaccacttcccccagtgttcccaagctctataatacatagtgagagcatgttcacctctcctggtcaatctgtggcaccacatggcaatgcatcctggggacatcctcaagggttccaacagcaaccacatcctgggggcttaaggccaccagctggtcccaaaggaaagcctccgaggccagtgcctctgtctcctagtgatggaatggtccagcccactcagccaaagcgtaaaatgcctgtgttagaaaaaccgctggtggatcaacttagcaaagaggagcaggattcactcaacacgaagtttgaagaagcaactgctgttgataaaaagttttcttttttcgcattttctatccgaagatatcttttaccccttccatatggcatttatatgaaatatttgtggatttgcgtagccatagtggatgaactcgaaaaagaaatagctgattccaagcagaaaattgatttcttccgtgctaagatgcaagaacttgttttatacaagagcagatgtgacaaccggtacaatgagatcgcagagagagtcttgggtgataaacgtgagcttgaatctctagcaaaaaaatacgaggagaaatacaagaagtctggcaatgtgggctctaaattgactattgaagaggccacattccgtgatatacaggagaagaaaatggaattgtaccaggcaatagtcaaatttgaagaaggcaaacttgatgatagtatagttaagcgcactgaacacatccagtcaggccttgaggaactgataaaaaatttgaatgagcgctgcaaacaatatggagtacgtgggaaacccacttctctggttgagcttccttttggttggcagcctggaatccaggaaggtgctgctgattgggatgaagattgggataagctagaggacgaagggtttaccttcgtcaaggagcttacacttgatattcaaaatgtcatagccccaccaaaggaaaaatcatcagcgtggagaaaagaagttgatgtctcttcaaaagaaggtgaagatgtttcattctcagatgctgactctaaaacggggaaaaagcaaagcagtggtgaagaagattctgagcagtcagagggtaaaacatccgatgttgatgccagagataaaaacggatctctggatgactctaaagttagaaagggcattgaagctgatagttcacctcgaacgaaagatacgaggagtgaaaatggccatgatgatggtgaatctactgcttctgctggcaaaactgtaaattatgactctcacgacgagacagattcagtttcaagcgtcaaccctgacaacggcaaggacaaggatcatgggaagtatgacagtggttttggatttggatttgggtttgatgacttcagtattaagcctataaaaactggttcgaccatttcaaatgacttcctccctcctaagttatctatatttgctgattccgtcccaagcccaccggcaaatgcaagcgacgtttcccctacaaaaccttctttgtttgctgattcagttccgagcactccagcgacgaacaatgcctcttacccaggccagaaatcattttttgatgactcggtcccgagcactcctgcttatccaggcaacttgtttgctgagaagaaatccttctttgacgactctgtcccgagcacccctgcttatccaggcaacttgtttgccgagaagaaatcctatttcgatgactctgtcccgagcactcctgcttatagcacgtctgattttggtgggaagccatttgcatcagagactcctcgttcagacaacctgttcccaggaagaagcccctttatgttcgactctgtcccaagtacacccgccgcacacgatgacttctctaacaacagcttctcccgcttcgattcattcaacagcaacaacaacgatgctttctctctatcccgcacagactcgatgcgcagcacaagcgagcctgacccattcgcatcaaggtttgattctttcaactatcaaagatatgattccttcaatgcacaaagctatgattcctctagcaacaacaatgcatcggagacgcctaaagcctcattgacaagattcgactcaattggaagcaccagggactctgattacagtcatgggtttgggttcgacgaccatgacccgttcggttctacaggaccattcaaaacaacgacaactacagcagagacacctcggagttctgataattggaatgctttctag

SEQ ID NO: 138 - protein, 1247 aa, Arabidopsis thaliana
MAAPRPTGGQDLFDTYFRRADLDGDGHISGAEAVAFFQGSNLPKHVLAQVWSYADSKKAGYLGRAEFYNALKLVTVAQSRRELTAEIVKAAIYSPASANIPAPKINLAATPSPQPRGVLPATQAQGVTSMPSVAAGVRGPHMGGTVSTSNQQVVPGQQNQFTGIPPSQTQQNFQSPGMPAGGTNAPRPANQPMPSDWLSGRSVGPSGNVNSQIPSSQSTYGLTAPNSTANHITKPHITPAVTSSTTTRPQESAPVHNPQESSATFGSRVSNVPSNQLVPKDPKELAASGNGFTSDSLFGDVFSVTSTQPKQHPTGSASTTGISSVTTGTVAGPEITQSVVRQSSIPQQGSLSQHAVGVQTQLTGNSGQPYTSSGAASGPPGSTVGVGISATSQLAQRPPHPHSQPQPRPQGQSQPPWPKMTPADVQKYTKVFVQVDTDRDGKITGNQARNLFLSWRLPRDALKQVWDLSDQDNDSMLSLREFCIAVYLMERYREGRPLPPVFPSSIIHSESMFTSPGQSVAPHGNASWGHPQGFQQQPHPGGLRPPAGPKGKPPRPVPLSPSDGMVQPTQPKRKMPVLEKPLVDQLSKEEQDSLNTKFEEATAVDKKFSFFAFSIRRYLLPLPYGIYMKYLWICVAIVDELEKEIADSKQKIDFFRAKMQELVLYKSRCDNRYNEIAERVLGDKRELESLAKKYEEKYKKSGNVGSKLTIEEATFRDIQEKKMELYQAIVKFEEGKLDDSIVKRTEHIQSGLEELIKNLNERCKQYGVRGKPTSLVELPFGWQPGIQEGAADWDEDWDKLEDEGFTFVKELTLDIQNVIAPPKEKSSAWRKEVDVSSKEGEDVSFSDADSKTGKKQSSGEEDSEQSEGKTSDVDARDKNGSLDDSKVRKGIEADSSPRTKDTRSENGHDDGESTASAGKTVNYDSHDETDSVSSVNPDNGKDKDHGKYDSGFGFGFGFDDFSIKPIKTGSTISNDFLPPKLSIFADSVPSPPANASDVSPTKPSLFADSVPSTPATNNASYPGQKSFFDDSVPSTPAYPGNLFAEKKSFFDDSVPSTPAYPGNLFAEKKSYFDDSVPSTPAYSTSDFGGKPFASETPRSDNLFPGRSPFMFDSVPSTPAAHDDFSNNSFSRFDSFNSNNNDAFSLSRTDSMRSTSEPDPFASRFDSFNYQRYDSFNAQSYDSSSNNNASETPKASLTRFDSIGSTRDSDYSHGFGFDDHDPFGSTGPFKTTTTTAETPRSSDNWNAF

SEQ ID NO: 139 - DNA, 515 bp, Populus tremula x tremuloides
  misc_feature: RNAi fragment of UB11CPC10
tgcctactgattctcctctctttcaactttctgccctctcaagctagctagaagggaagatgaacagaccaggagattggaattgcaggtcatgccaacacttgaacttccagaggagggactcgtaccagcgttgtggggacccaaggcccggagagagagaacattatggaagttttggtggaagatcagggggctcgttcggatttacggggcctgatgttaggcctggtgactggtattgctcggctggcaactgtggagctcacaactttgctagtcgttcaagctgcttcaagtgtggtatgtccaaggatgaatcctccggtggcgggcttgatgctgacatttcatggatgagaggttgtggcttcggcggtggcagcgcctctagccgctctaattggaaatccggagactggatttgcaccaggtcaggttgcaacgagcacaactttgctagcaggactgagtgttacagatgcaatgcaccaagagaatcaggcggcaacaag

SEQ ID NO: 140 - DNA, 313 bp, Populus tremula x tremuloides
  misc_feature: RNAi fragment of G079P71
gacttgccattgaaggatgacgacagcctcacgagctgcccgccattttcagtgccgaactacatgactcctacggcctcggccaaggcaaaaacaagagcttatagtaatcccaaggagaggtttccagggaccccgaacagtgaaaagaggagactctcgttccctcttgcacaaggcattggatctttcaagtggaacaaaggcgccgccttcttcaccggcaaggattcaagctctcagaggggtttagagaagcatcagtcacttcaatccataggagatttgagtgtggattcaaccgtctcgatgc

SEQ ID NO: 141 - DNA, 254 bp, Populus tremula x tremuloides
  misc_feature: RNAi fragment of A044P01
gtgagcggagttgaaatgttcctcaaacaggccattggacagttcaacctcttcaccggcagagaagcgccgcaagagttcatgcgggagattgttttagccaaattctgatttattgcatcatgcaaagtatgctgcaatgagtgataaaaataaactgttatctaatttcaaatattaactcataaatcaaagttgatggattgttgagaccagttttgtcatcaaatatccagtgttagtgatggccactg

SEQ ID NO: 142 - DNA, 258 bp, Populus tremula x tremuloides
  misc_feature: RNAi fragment of F129P33
ttcaaccattaccctccttgtcctgcaccccacctagctcttggtgtaggtaggcacaaggatggaggtgccttgacggtcttatcccaagatgatgttggaggactacaaataggccgcagatcagatggagaatggatccctgctaaaccaattccagatgcctttatcatcaatattggtaattgtatgcaggtttggagcaatgacttgtactggagtgcagagcatagagtggtggtgaattctcaaagggaa

SEQ ID NO: 143 - DNA, 274 bp, Populus tremula x tremuloides
  misc_feature: RNAi fragment of UB30CPG09
aagaaacctaacacagatcgatcggttaaaacaaagatgccttcccgtagaagaactctcttgaaggttatcatcctcggcgacagcggggtaggaaagacctctttgatgaatcaatatgtaaataagaagtttagcaatcaatacaaggcgacaattggagcggattttttgactaaggaagttcagtttgaagataggctcttcactttacagatttgggatactgctgggcaggaaagattccaaagccttggtgtagctttctatcgtg

SEQ ID NO: 144 - DNA, 261 bp, Populus tremula x tremuloides
  misc_feature: RNAi fragment of G125P68
atttaaccctgcaggcaacaaggactcttctgagaacgagagagatttctttggatctgatgattttggtctaaagccaatcagaacggaatccacatcaacaacgaatactttccagaaaaagagtatattttttgaagaatctgttgcaggttccccaatgtcaagatttggcaactctccaaggttcagcgaagcaggggaccattttgacaattactcgagatttgattccttcagcatgaacgaaggaggcttttc

The invention claimed is:

1. A method for producing a genetically modified woody plant having increased biomass and/or wood density compared to a control woody plant of the same species, said method comprising:
   a) transforming a cell of a woody plant with a genetic construct comprising a promoter operably linked to a polynucleotide sequence encoding a heterologous polypeptide having at least 95% amino acid sequence identity to the amino acid sequence as set forth in SEQ ID NO: 2, over-expressing said heterologous polypeptide in said transformed woody plant cell to produce a genetically modified woody plant cell, and obtaining genetically modified woody plants and parts thereof comprising said genetic construct from said genetically modified woody plant cell;
   b) selecting a genetically modified woody plant or part thereof from said genetically modified woody plants and parts thereof of step a) with improved biomass and/or wood density as compared to a control woody plant or a part thereof of the same species; and
   c) growing the genetically modified woody plant or part thereof of step b) under conditions which permit development of the genetically modified woody plant.

2. The method according to claim 1, further comprising:
   d) selfing or crossing the genetically modified woody plant of step c) with itself or another woody plant of the same species to produce seed, wherein said seed comprises said genetic construct; and
   e) growing a progeny of woody plant from said seed of step d), wherein the progeny woody plant comprises said genetic construct and has increased biomass and/or wood density as compared to a control woody plant of the same species.

3. The method according to claim 1, wherein the heterologous polypeptide has the amino acid sequence as set forth in SEQ ID NO: 2.

4. The method according to claim 1, wherein the polynucleotide sequence comprises the nucleotide sequence as set forth in SEQ ID NO: 1.

5. The method according to claim 1, wherein said genetic construct is present in a binary plant transformation vector.

6. The method according to claim 1, wherein the genetically modified woody plant is a hardwood tree selected from the group consisting of acacia, *eucalyptus*, hornbeam, beech, mahogany, walnut, oak, ash, willow, hickory, birch, chestnut, poplar, alder, aspen, maple, sycamore, ginkgo, a palm tree, sweet gum, cypress, Douglas fir, fir, *sequoia*, hemlock, cedar, juniper, larch, pine, redwood, spruce and yew.

* * * * *